United States Patent 11,446,398 (REGULATED BIOCIRCUIT SYSTEMS) - sequence listing, part 5

SEQ ID NO: 15045 - protein, 19 aa, Homo sapiens
  Payload ID: 2943
  Gene Symbol: CHRNA2
  Gene Name: cholinergic receptor, nicotinic, alpha 2 (neuronal)
  ENSP ID: ENSP00000430994
MGPSCPVFLSFTKLSLWWL

SEQ ID NO: 15046 - protein, 489 aa, Homo sapiens
  Payload ID: 2944
  Gene Symbol: CHRNA3
  Gene Name: cholinergic receptor, nicotinic, alpha 3 (neuronal)
  Uniprot ID: P32297
  ENSP ID: ENSP00000267951
MGSGPLSLPLALSPPRLLLLLLLSLLPVARASEAEHRLFERLFEDYNEIIRPVANVSDPVIIHFEVSMSQLVKVDEVNQIMETNLWLKQIWNDYKLKWNPSDYGGAEFMRVPAQKIWKPDIVLYNNAVGDFQVDDKTKALLKYTGEVTWIPPAIFKSSCKIDVTYFPFDYQNCTMKFGSWSYDKAKIDLVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEEQKAQEIQQLKRKEKSTETSDQEPGL

SEQ ID NO: 15047 - protein, 505 aa, Homo sapiens
  Payload ID: 2944
  Gene Symbol: CHRNA3
  Gene Name: cholinergic receptor, nicotinic, alpha 3 (neuronal)
  Uniprot ID: P32297
  ENSP ID: ENSP00000315602
MGSGPLSLPLALSPPRLLLLLLLSLLPVARASEAEHRLFERLFEDYNEIIRPVANVSDPVIIHFEVSMSQLVKVDEVNQIMETNLWLKQIWNDYKLKWNPSDYGGAEFMRVPAQKIWKPDIVLYNNAVGDFQVDDKTKALLKYTGEVTWIPPAIFKSSCKIDVTYFPFDYQNCTMKFGSWSYDKAKIDLVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEIQDDWKYVAMVIDRIFLWVFTLVCILGTAGLFLQPLMAREDA

SEQ ID NO: 15048 - protein, 505 aa, Homo sapiens; identical to SEQ ID NO: 15047
  Payload ID: 2944
  Gene Symbol: CHRNA3
  Gene Name: cholinergic receptor, nicotinic, alpha 3 (neuronal)
  Uniprot ID: P32297
  ENSP ID: ENSP00000452896

SEQ ID NO: 15049 - protein, 17 aa, Homo sapiens
  Payload ID: 2944
  Gene Symbol: CHRNA3
  Gene Name: cholinergic receptor, nicotinic, alpha 3 (neuronal)
  ENSP ID: ENSP00000453993
MSQLVKVDEVNQIMETN

SEQ ID NO: 15050 - protein, 627 aa, Homo sapiens
  Payload ID: 2945
  Gene Symbol: CHRNA4
  Gene Name: cholinergic receptor, nicotinic, alpha 4 (neuronal)
  Uniprot ID: P43681
  ENSP ID: ENSP00000359285
MELGGPGAPRLLPPLLLLLGTGLLRASSHVETRAHAEERLLKKLFSGYNKWSRPVANISDVVLVRFGLSIAQLIDVDEKNQMMTTNVWVKQEWHDYKLRWDPADYENVTSIRIPSELIWRPDIVLYNNADGDFAVTHLTKAHLFHDGRVQWTPPAIYKSSCSIDVTFFPFDQQNCTMKFGSWTYDKAKIDLVNMHSRVDQLDFWESGEWVIVDAVGTYNTRKYECCAEIYPDITYAFVIRRLPLFYTINLIIPCLLISCLTVLVFYLPSECGEKITLCISVLLSLTVFLLLITEIIPSTSLVIPLIGEYLLFTMIFVTLSIVITVFVLNVHHRSPRTHTMPTWVRRVFLDIVPRLLLMKRPSVVKDNCRRLIESMHKMASAPRFWPEPEGEPPATSGTQSLHPPSPSFCVPLDVPAEPGPSCKSPSDQLPPQQPLEAEKASPHPSPGPCRPPHGTQAPGLAKARSLSVQHMSSPGEAVEGGVRCRSRSIQYCVPRDDAAPEADGQAAGALASRNTHSAELPPPDQPSPCKCTCKKEPSSVSPSATVKTRSTKAPPPHLPLSPALTRAVEGVQYIADHLKAEDTDFSVKEDWKYVAMVIDRIFLWMFIIVCLLGTVGLFLPPWLAGMI

SEQ ID NO: 15051 - protein, 137 aa, Homo sapiens
  Payload ID: 2945
  Gene Symbol: CHRNA4
  Gene Name: cholinergic receptor, nicotinic, alpha 4 (neuronal)
  ENSP ID: ENSP00000429513
  MOD_RES (1)..(1): Any amino acid
XSSHVETRAHAEERLLKKLFSGYNKWSRPVANISDVVLVRFGLSIAQLIDVDEKNQMMTTNVWVKQEWHDYKLRWDPADYENVTSIRIPSELIWRPDIVLYNNCRRALLGRSAFRHQTPSWPFWENSVDCRVPWRGC

SEQ ID NO: 15052 - protein, 556 aa, Homo sapiens
  Payload ID: 2945
  Gene Symbol: CHRNA4
  Gene Name: cholinergic receptor, nicotinic, alpha 4 (neuronal)
  Uniprot ID: P43681
  ENSP ID: ENSP00000483388
MRMSPPSASPPSSSGGRTSSSTTTAGEPFWAGVLFAIRPHPGLSGRIVWTAGCPGEGADGDFAVTHLTKAHLFHDGRVQWTPPAIYKSSCSIDVTFFPFDQQNCTMKFGSWTYDKAKIDLVNMHSRVDQLDFWESGEWVIVDAVGTYNTRKYECCAEIYPDITYAFVIRRLPLFYTINLIIPCLLISCLTVLVFYLPSECGEKITLCISVLLSLTVFLLLITEIIPSTSLVIPLIGEYLLFTMIFVTLSIVITVFVLNVHHRSPRTHTMPTWVRRVFLDIVPRLLLMKRPSVVKDNCRRLIESMHKMASAPRFWPEPEGEPPATSGTQSLHPPSPSFCVPLDVPAEPGPSCKSPSDQLPPQQPLEAEKASPHPSPGPCRPPHGTQAPGLAKARSLSVQHMSSPGEAVEGGVRCRSRSIQYCVPRDDAAPEADGQAAGALASRNTHSAELPPPDQPSPCKCTCKKEPSSVSPSATVKTRSTKAPPPHLPLSPALTRAVEGVQYIADHLKAEDTDFSVKEDWKYVAMVIDRIFLWMFIIVCLLGTVGLFLPPWLAGMI

SEQ ID NO: 15053 - protein, 111 aa, Homo sapiens
  Payload ID: 2945
  Gene Symbol: CHRNA4
  Gene Name: cholinergic receptor, nicotinic, alpha 4 (neuronal)
  ENSP ID: ENSP00000486914
MELGGPGAPRLLPPLLLLLGTGLLRASSHVETRAHAEERLLKKLFSGYNKWSRPVANISDVVLVRFGLSIAQLIDVDEKNQMMTTNVWVKQPPPAPPHPGVARLQAALGPS

SEQ ID NO: 15054 - protein, 468 aa, Homo sapiens
  Payload ID: 2946
  Gene Symbol: CHRNA5
  Gene Name: cholinergic receptor, nicotinic, alpha 5 (neuronal)
  Uniprot ID: P30532
  ENSP ID: ENSP00000299565
MAARGSGPRALRLLLLVQLVAGRCGLAGAAGGAQRGLSEPSSIAKHEDSLLKDLFQDYERWVRPVEHLNDKIKIKFGLAISQLVDVDEKNQLMTTNVWLKQEWIDVKLRWNPDDYGGIKVIRVPSDSVWTPDIVLFDNADGRFEGTSTKTVIRYNGTVTWTPPANYKSSCTIDVTFFPFDLQNCSMKFGSWTYDGSQVDIILEDQDVDKRDFFDNGEWEIVSATGSKGNRTDSCCWYPYVTYSFVIKRLPLFYTLFLIIPCIGLSFLTVLVFYLPSNEGEKICLCTSVLVSLTVFLLVIEEIIPSSSKVIPLIGEYLVFTMIFVTLSIMVTVFAINIHHRSSSTHNAMAPLVRKIFLHTLPKLLCMRSHVDRYFTQKEETESGSGPKSSRNTLEAALDSIRYITRHIMKENDVREVVEDWKFIAQVLDRMFLWTFLFVSIVGSLGLFVPVIYKWANILIPVHIGNANK

SEQ ID NO: 15055 - protein, 182 aa, Homo sapiens
  Payload ID: 2946
  Gene Symbol: CHRNA5
  Gene Name: cholinergic receptor, nicotinic, alpha 5 (neuronal)
  ENSP ID: ENSP00000378281
  MOD_RES (1)..(1): Any amino acid
XRPVEHLNDKIKIKFGLAISQLVDVDEKNQLMTTNVWLKQEWIDVKLRWNPDDYGGIKVIRVPSDSVWTPDIVLFDNADGRFEGTSTKTVIRYNGTVTWTPPANYKSSCTIDVTFFPFDLQNCSMKFGSWTYDGSQVDIILEDQDVDKRDFFDNGEWEIVSATGSKGNRTDSCCWLLKIGNS

SEQ ID NO: 15056 - protein, 56 aa, Homo sapiens
  Payload ID: 2946
  Gene Symbol: CHRNA5
  Gene Name: cholinergic receptor, nicotinic, alpha 5 (neuronal)
  ENSP ID: ENSP00000452641
  MOD_RES (1)..(1): Any amino acid
XTLSIMVTVFAINIHHRSSSTHNAMAPLVRKIFLHTLPKLLCMRSHVDRLLKIGNS

SEQ ID NO: 15057 - protein, 160 aa, Homo sapiens
  Payload ID: 2946
  Gene Symbol: CHRNA5
  Gene Name: cholinergic receptor, nicotinic, alpha 5 (neuronal)
  ENSP ID: ENSP00000453519
MAARGSGPRALRLLLLVQLVAGRCGLAGAAGGAQRGLSEPSSIAKHEDSLLKDLFQDYERWVRPVEHLNDKIKIKFGLAISQLVDVDEKNQLMTTNVWLKQEWIDVKLRWNPDDYGGIKVIRVPSDSVWTPDIVLFDNADGRFEGTSTKTVIRLLKIGNS

SEQ ID NO: 15058 - protein, 494 aa, Homo sapiens
  Payload ID: 2947
  Gene Symbol: CHRNA6
  Gene Name: cholinergic receptor, nicotinic, alpha 6 (neuronal)
  Uniprot ID: Q15825
  ENSP ID: ENSP00000276410
MLTSKGQGFLHGGLCLWLCVFTPFFKGCVGCATEERLFHKLFSHYNQFIRPVENVSDPVTVHFEVAITQLANVDEVNQIMETNLWLRHIWNDYKLRWDPMEYDGIETLRVPADKIWKPDIVLYNNAVGDFQVEGKTKALLKYNGMITWTPPAIFKSSCPMDITFFPFDHQNCSLKFGSWTYDKAEIDLLIIGSKVDMNDFWENSEWEIIDASGYKHDIKYNCCEEIYTDITYSFYIRRLPMFYTINLIIPCLFISFLTVLVFYLPSDCGEKVTLCISVLLSLTVFLLVITETIPSTSLVVPLVGEYLLFTMIFVTLSIVVTVFVLNIHYRTPTTHTMPRWVKTVFLKLLPQVLLMRWPLDKTRGTGSDAVPRGLARRPAKGKLASHGEPRHLKECFHCHKSNELATSKRRLSHQPLQWVVENSEHSPEVEDVINSVQFIAENMKSHNETKEVEDDWKYVAMVVDRVFLWVFIIVCVFGTAGLFLQPLLGNTGKS

SEQ ID NO: 15059 - protein, 479 aa, Homo sapiens
  Payload ID: 2947
  Gene Symbol: CHRNA6
  Gene Name: cholinergic receptor, nicotinic, alpha 6 (neuronal)
  Uniprot ID: Q15825
  ENSP ID: ENSP00000433871
MLTSKGQGFLHGGLCLWLCVFTPFFKGCVGCATEERLFHKLFSHYNQFIRPVENVSDPVTVHFEVAITQLANVIWNDYKLRWDPMEYDGIETLRVPADKIWKPDIVLYNNAVGDFQVEGKTKALLKYNGMITWTPPAIFKSSCPMDITFFPFDHQNCSLKFGSWTYDKAEIDLLIIGSKVDMNDFWENSEWEIIDASGYKHDIKYNCCEEIYTDITYSFYIRRLPMFYTINLIIPCLFISFLTVLVFYLPSDCGEKVTLCISVLLSLTVFLLVITETIPSTSLVVPLVGEYLLFTMIFVTLSIVVTVFVLNIHYRTPTTHTMPRWVKTVFLKLLPQVLLMRWPLDKTRGTGSDAVPRGLARRPAKGKLASHGEPRHLKECFHCHKSNELATSKRRLSHQPLQWVVENSEHSPEVEDVINSVQFIAENMKSHNETKEVEDDWKYVAMVVDRVFLWVFIIVCVFGTAGLFLQPLLGNTGKS

SEQ ID NO: 15060 - protein, 111 aa, Homo sapiens
  Payload ID: 2947
  Gene Symbol: CHRNA6
  Gene Name: cholinergic receptor, nicotinic, alpha 6 (neuronal)
  ENSP ID: ENSP00000434659
METNLWLRHIWNDYKLRWDPMEYDGIETLRVPADKIWKPDIVLYNNAVGDFQVEGKTKALLKYNGMITWTPPAIFKSSCPMDITFFPFDHQNCSLKFGSWTYDKAEIDLLI

SEQ ID NO: 15061 - protein, 502 aa, Homo sapiens; identical to SEQ ID NO: 15028
  Payload ID: 2948
  Gene Symbol: CHRNA7
  Gene Name: cholinergic receptor, nicotinic, alpha 7 (neuronal)
  Uniprot ID: P36544
  ENSP ID: ENSP00000303727

SEQ ID NO: 15062 - protein, 102 aa, Homo sapiens
  Payload ID: 2948
  Gene Symbol: CHRNA7
  Gene Name: cholinergic receptor, nicotinic, alpha 7 (neuronal)
  ENSP ID: ENSP00000399087
MRCSPGGVWLALAASLLHVSLQGEFQRKLYKELVKNYNPLERPVANDSQPLTVYFSLSLLQIMDVDEKNQVLTTNIWLQMAYSRVPATSMYAGFPLMCSTAN

SEQ ID NO: 15063 - protein, 502 aa, Homo sapiens; identical to SEQ ID NO: 15028
  Payload ID: 2948
  Gene Symbol: CHRNA7
  Gene Name: cholinergic receptor, nicotinic, alpha 7 (neuronal)
  ENSP ID: ENSP00000405989

SEQ ID NO: 15064 - protein, 531 aa, Homo sapiens
  Payload ID: 2948
  Gene Symbol: CHRNA7
  Gene Name: cholinergic receptor, nicotinic, alpha 7 (neuronal)
  Uniprot ID: P36544
  ENSP ID: ENSP00000407546
MRCSPGGVWLALAASLLHGKATASPPSTPPWDPGHIPGASVRPAPGPVSLQGEFQRKLYKELVKNYNPLERPVANDSQPLTVYFSLSLLQIMDVDEKNQVLTTNIWLQMSWTDHYLQWNVSEYPGVKTVRFPDGQIWKPDILLYNSADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 15065 - protein, 479 aa, Homo sapiens
  Payload ID: 2949
  Gene Symbol: CHRNA9
  Gene Name: cholinergic receptor, nicotinic, alpha 9 (neuronal)
  Uniprot ID: Q9UGM1
  ENSP ID: ENSP00000312663
MNWSHSCISFCWIYFAASRLRAAETADGKYAQKLFNDLFEDYSNALRPVEDTDKVLNVTLQITLSQIKDMDERNQILTAYLWIRQIWHDAYLTWDRDQYDGLDSIRIPSDLVWRPDIVLYNKADDESSEPVNTNVVLRYDGLITWDAPAITKSSCVVDVTYFPFDNQQCNLTFGSWTYNGNQVDIFNALDSGDLSDFIEDVEWEVHGMPAVKNVISYGCCSEPYPDVTFTLLLKRRSSFYIVNLLIPCVLISFLAPLSFYLPAASGEKVSLGVTILLAMTVFQLMVAEIMPASENVPLIGKYYIATMALITASTALTIMVMNIHFCGAEARPVPHWARVVILKYMSRVLFVYDVGESCLSPHHSRERDHLTKVYSKLPESNLKAARNKDLSRKKDMNKRLKNDLGCQGKNPQEAESYCAQYKVLTRNIEYIAKCLKDHKATNSKGSEWKKVAKVIDRFFMWIFFIMVFVMTILIIARAD

SEQ ID NO: 15066 - protein, 501 aa, Homo sapiens
  Payload ID: 2950
  Gene Symbol: CHRNB1
  Gene Name: cholinergic receptor, nicotinic, beta 1 (muscle)
  Uniprot ID: P11230
  ENSP ID: ENSP00000304290
MTPGALLMLLGALGAPLAPGVRGSEAEGRLREKLFSGYDSSVRPAREVGDRVRVSVGLILAQLISLNEKDEEMSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 15067 - protein, 429 aa, Homo sapiens
  Payload ID: 2950
  Gene Symbol: CHRNB1
  Gene Name: cholinergic receptor, nicotinic, beta 1 (muscle)
  Uniprot ID: P11230
  ENSP ID: ENSP00000439209
MSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 15068 - protein, 380 aa, Homo sapiens
  Payload ID: 2950
  Gene Symbol: CHRNB1
  Gene Name: cholinergic receptor, nicotinic, beta 1 (muscle)
  ENSP ID: ENSP00000459092
MSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 15069 - protein, 316 aa, Homo sapiens
  Payload ID: 2950
  Gene Symbol: CHRNB1
  Gene Name: cholinergic receptor, nicotinic, beta 1 (muscle)
  ENSP ID: ENSP00000460648
  MOD_RES (1)..(1): Any amino acid
XPAREVGDRVRVSVGLILAQLISLNEKDEEMSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVA

SEQ ID NO: 15070 - protein, 158 aa, Homo sapiens
  Payload ID: 2950
  Gene Symbol: CHRNB1
  Gene Name: cholinergic receptor, nicotinic, beta 1 (muscle)
  ENSP ID: ENSP00000461402
MTPGALLMLLGALGAPLAPGVRGSEAEGRLREKLFSGYDSSVRPAREVGDRVRVSVGLILAQLISLNEKDEEMSTKVYLDLAVLECGGSSHPPASGGTSTSAEITAEWTDYRLSWDPAEHDGIDSLRITAESVWLPDVVLLNNNDGNFDVALDISVVV

SEQ ID NO: 15071 - protein, 37 aa, Homo sapiens
  Payload ID: 2950
  Gene Symbol: CHRNB1
  Gene Name: cholinergic receptor, nicotinic, beta 1 (muscle)
  ENSP ID: ENSP00000461751
MVVDRLFLWTFIIFTSVGTLVIFLDATYHLPPPDPFP

SEQ ID NO: 15072 - protein, 502 aa, Homo sapiens
  Payload ID: 2951
  Gene Symbol: CHRNB2
  Gene Name: cholinergic receptor, nicotinic, beta 2 (neuronal)
  Uniprot ID: P17787
  ENSP ID: ENSP00000357461
MARRCGPVALLLGFGLLRLCSGVWGTDTEERLVEHLLDPSRYNKLIRPATNGSELVTVQLMVSLAQLISVHEREQIMTTNVWLTQEWEDYRLTWKPEEFDNMKKVRLPSKHIWLPDVVLYNNADGMYEVSFYSNAVVSYDGSIFWLPPAIYKSACKIEVKHFPFDQQNCTMKFRSWTYDRTEIDLVLKSEVASLDDFTPSGEWDIVALPGRRNENPDDSTYVDITYDFIIRRKPLFYTINLIIPCVLITSLAILVFYLPSDCGEKMTLCISVLLALTVFLLLISKIVPPTSLDVPLVGKYLMFTMVLVTFSIVTSVCVLNVHHRSPTTHTMAPWVKVVFLEKLPALLFMQQPRHHCARQRLRLRRRQREREGAGALFFREAPGADSCTCFVNRASVQGLAGAFGAEPAPVAGPGRSGEPCGCGLREAVDGVRFIADHMRSEDDDQSVSEDWKYVAMVIDRLFLWIFVFVCVFGTIGMFLQPLFQNYTTTTFLHSDHSAPSSK

SEQ ID NO: 15073 - protein, 458 aa, Homo sapiens
  Payload ID: 2952
  Gene Symbol: CHRNB3
  Gene Name: cholinergic receptor, nicotinic, beta 3 (neuronal)
  Uniprot ID: Q05901
  ENSP ID: ENSP00000289957
MLPDFMLVLIVLGIPSSATTGFNSIAENEDALLRHLFQGYQKWVRPVLHSNDTIKVYFGLKISQLVDVDEKNQLMTTNVWLKQEWTDHKLRWNPDDYGGIHSIKVPSESLWLPDIVLFENADGRFEGSLMTKVIVKSNGTVVWTPPASYKSSCTMDVTFFPFDRQNCSMKFGSWTYDGTMVDLILINENVDRKDFFDNGEWEILNAKGMKGNRRDGVYSYPFITYSFVLRRLPLFYTLFLIIPCLGLSFLTVLVFYLPSDEGEKLSLSTSVLVSLTVFLLVIEEIIPSSSKVIPLIGEYLLFIMIFVTLSIIVTVFVINVHHRSSSTYHPMAPWVKRLFLQKLPKLLCMKDHVDRYSSPEKEESQPVVKGKVLEKKKQKQLSDGEKVLVAFLEKAADSIRYISRHVKKEHFISQVVQDWKFVAQVLDRIFLWLFLIVSVTGSVLIFTPALKMWLHSYH

SEQ ID NO: 15074 - protein, 9 aa, Homo sapiens
  Payload ID: 2952
  Gene Symbol: CHRNB3
  Gene Name: cholinergic receptor, nicotinic, beta 3 (neuronal)
  ENSP ID: ENSP00000433913
MTTNVWLKQ

SEQ ID NO: 15075 - protein, 498 aa, Homo sapiens
  Payload ID: 2953
  Gene Symbol: CHRNB4
  Gene Name: cholinergic receptor, nicotinic, beta 4 (neuronal)
  Uniprot ID: P30926
  ENSP ID: ENSP00000261751
MRRAPSLVLFFLVALCGRGNCRVANAEEKLMDDLLNKTRYNNLIRPATSSSQLISIKLQLSLAQLISVNEREQIMTTNVWLKQEWTDYRLTWNSSRYEGVNILRIPAKRIWLPDIVLYNNADGTYEVSVYTNLIVRSNGSVLWLPPAIYKSACKIEVKYFPFDQQNCTLKFRSWTYDHTEIDMVLMTPTASMDDFTPSGEWDIVALPGRRTVNPQDPSYVDVTYDFIIKRKPLFYTINLIIPCVLTTLLAILVFYLPSDCGEKMTLCISVLLALTFFLLLISKIVPPTSLDVPLIGKYLMFTMVLVTFSIVTSVCVLNVHHRSPSTHTMAPWVKRCFLHKLPTFLFMKRPGPDSSPARAFPPSKSCVTKPEATATSTSPSNFYGNSMYFVNPASAASKSPAGSTPVAIPRDFWLRSSGRFRQDVQEALEGVSFIAQHMKNDDEDQSVVEDWKYVAMVVDRLFLWVFMFVCVLGTVGLFLPPLFQTHAASEGPYAAQRD

SEQ ID NO: 15076 - protein, 231 aa, Homo sapiens
  Payload ID: 2953
  Gene Symbol: CHRNB4
  Gene Name: cholinergic receptor, nicotinic, beta 4 (neuronal)
  Uniprot ID: P30926
  ENSP ID: ENSP00000416386
MRRAPSLVLFFLVALCGRGNCRVANAEEKLMDDLLNKTRYNNLIRPATSSSQLISIKLQLSLAQLISVNEREQIMTTNVWLKQEWTDYRLTWNSSRYEGVNILRIPAKRIWLPDIVLYNKSLRTGSTWLWWWTGCSCGCSCLCASWALWGSSYRPSSRPMQLLRGPTLPSVTEGPLGCGVRGCEWPGGHFAASFWVVADEALSKYVSIGHQPHQTSHSRGTGKDGGLGCPL

SEQ ID NO: 15077 - protein, 66 aa, Homo sapiens
  Payload ID: 2953
  Gene Symbol: CHRNB4
  Gene Name: cholinergic receptor, nicotinic, beta 4 (neuronal)
  ENSP ID: ENSP00000457404
MGGSLLAPAPDHIVLWNCRVANAEEKLMDDLLNKTRYNNLIRPATSSSQLISIKLQLSLAQLISVG

SEQ ID NO: 15078 - protein, 517 aa, Homo sapiens
  Payload ID: 2954
  Gene Symbol: CHRND
  Gene Name: cholinergic receptor, nicotinic, delta (muscle)
  Uniprot ID: Q07001
  ENSP ID: ENSP00000258385
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDWQNCSLKFSSLKYTAKEITLSLKQDAKENRTYPVEWIIIDPEGFTENGEWEIVHRPARVNVDPRAPLDSPSRQDITFYLIIRRKPLFYIINILVPCVLISFMVNLVFYLPADSGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 15079 - protein, 171 aa, Homo sapiens
  Payload ID: 2954
  Gene Symbol: CHRND
  Gene Name: cholinergic receptor, nicotinic, delta (muscle)
  ENSP ID: ENSP00000398143
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDWQNCSLKFRW

SEQ ID NO: 15080 - protein, 172 aa, Homo sapiens
  Payload ID: 2954
  Gene Symbol: CHRND
  Gene Name: cholinergic receptor, nicotinic, delta (muscle)
  ENSP ID: ENSP00000404950
MEGPVLTLGLLAALAVCGSWGLNEEERLIRHLFQEKGYNKELRPVAHKEESVDVALALTLSNLISLGWTDNRLKWNAEEFGNISVLRLPPDMVWLPEIVLENNNDGSFQISYSCNVLVYHYGFVYWLPPAIFRSSCPISVTYFPFDWQNCSLKFSSLKYTAKEITLSLKQDA

SEQ ID NO: 15081 - protein, 235 aa, Homo sapiens
  Payload ID: 2954
  Gene Symbol: CHRND
  Gene Name: cholinergic receptor, nicotinic, delta (muscle)
  ENSP ID: ENSP00000408819
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDWQNCSLKFRERGVGDSPPAGQGQRGPQSPSGQPQPPGHHLLPHHPPQAPLLHHQHPGALRAHLLHGQPGLLPTG

SEQ ID NO: 15082 - protein, 108 aa, Homo sapiens
  Payload ID: 2954
  Gene Symbol: CHRND
  Gene Name: cholinergic receptor, nicotinic, delta (muscle)
  ENSP ID: ENSP00000410801
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMQ

SEQ ID NO: 15083 - protein, 502 aa, Homo sapiens
  Payload ID: 2954
  Gene Symbol: CHRND
  Gene Name: cholinergic receptor, nicotinic, delta (muscle)
  Uniprot ID: Q07001
  ENSP ID: ENSP00000438380
MEGPVLTLGLLAALAVCGSWGLNEEERLIRHLFQEKGYNKELRPVAHKEESVDVALALTLSNLISLGWTDNRLKWNAEEFGNISVLRLPPDMVWLPEIVLENNNDGSFQISYSCNVLVYHYGFVYWLPPAIFRSSCPISVTYFPFDWQNCSLKFSSLKYTAKEITLSLKQDAKENRTYPVEWIIIDPEGFTENGEWEIVHRPARVNVDPRAPLDSPSRQDITFYLIIRRKPLFYIINILVPCVLISFMVNLVFYLPADSGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 15084 - protein, 493 aa, Homo sapiens
  Payload ID: 2955
  Gene Symbol: CHRNE
  Gene Name: cholinergic receptor, nicotinic, epsilon (muscle)
  Uniprot ID: Q04844
  ENSP ID: ENSP00000293780
MARAPLGVLLLLGLLGRGVGKNEELRLYHHLFNNYDPGSRPVREPEDTVTISLKVTLTNLISLNEKEETLTTSVWIGIDWQDYRLNYSKDDFGGIETLRVPSELVWLPEIVLENNIDGQFGVAYDANVLVYEGGSVTWLPPAIYRSVCAVEVTYFPFDWQNCSLIFRSQTYNAEEVEFTFAVDNDGKTINKIDIDTEAYTENGEWAIDFCPGVIRRHHGGATDGPGETDVIYSLIIRRKPLFYVINIIVPCVLISGLVLLAYFLPAQAGGQKCTVSINVLLAQTVFLFLIAQKIPETSLSVPLLGRFLIFVMVVATLIVMNCVIVLNVSQRTPTTHAMSPRLRHVLLELLPRLLGSPPPPEAPRAASPPRRASSVGLLLRAEELILKKPRSELVFEGQRHRQGTWTAAFCQSLGAAAPEVRCCVDAVNFVAESTRDQEATGEEVSDWVRMGNALDNICFWAALVLFSVGSSLIFLGAYFNRVPDLPYAPCIQP

SEQ ID NO: 15085 - protein, 465 aa, Homo sapiens
  Payload ID: 2956
  Gene Symbol: CHRNG
  Gene Name: cholinergic receptor, nicotinic, gamma (muscle)
  Uniprot ID: P07510
  ENSP ID: ENSP00000374143
MHGGQGPLLLLLLLAVCLGAQGRNQEERLLADLMQNYDPNLRPAERDSDVVNVSLKLTLTNLISLNEREEALTTNVWIEMQWCDYRLRWDPRDYEGLWVLRVPSTMVWRPDIVLENKSQTYSTNEIDLQLSQEDGQTIEWIFIDPEAFTENGEWAIQHRPAKMLLDPAAPAQEAGHQKVVFYLLIQRKPLFYVINIIAPCVLISSVAILIHFLPAKAGGQKCTVAINVLLAQTVFLFLVAKKVPETSQAVPLISKYLTFLLVVTILIVVNAVVVLNVSLRSPHTHSMARGVRKVFLRLLPQLLRMHVRPLAPAAVQDTQSRLQNGSSGWSITTGEEVALCLPRSELLFQQWQRQGLVAAALEKLEKGPELGLSQFCGSLKQAAPAIQACVEACNLIACARHQQSHFDNGNEEWFLVGRVLDRVCFLAMLSLFICGTAGIFLMAHYNRVPALPFPGDPRPYLPSPD

SEQ ID NO: 15086 - protein, 517 aa, Homo sapiens
  Payload ID: 2956
  Gene Symbol: CHRNG
  Gene Name: cholinergic receptor, nicotinic, gamma (muscle)
  Uniprot ID: P07510
  ENSP ID: ENSP00000374145
MHGGQGPLLLLLLLAVCLGAQGRNQEERLLADLMQNYDPNLRPAERDSDVVNVSLKLTLTNLISLNEREEALTTNVWIEMQWCDYRLRWDPRDYEGLWVLRVPSTMVWRPDIVLENNVDGVFEVALYCNVLVSPDGCIYWLPPAIFRSACSISVTYFPFDWQNCSLIFQSQTYSTNEIDLQLSQEDGQTIEWIFIDPEAFTENGEWAIQHRPAKMLLDPAAPAQEAGHQKVVFYLLIQRKPLFYVINIIAPCVLISSVAILIHFLPAKAGGQKCTVAINVLLAQTVFLFLVAKKVPETSQAVPLISKYLTFLLVVTILIVVNAVVVLNVSLRSPHTHSMARGVRKVFLRLLPQLLRMHVRPLAPAAVQDTQSRLQNGSSGWSITTGEEVALCLPRSELLFQQWQRQGLVAAALEKLEKGPELGLSQFCGSLKQAAPAIQACVEACNLIACARHQQSHFDNGNEEWFLVGRVLDRVCFLAMLSLFICGTAGIFLMAHYNRVPALPFPGDPRPYLPSPD

SEQ ID NO: 15087 - protein, 359 aa, Homo sapiens
  Payload ID: 2957
  Gene Symbol: CHAD
  Gene Name: chondroadherin
  Uniprot ID: O15335
  ENSP ID: ENSP00000258969
MVRPMLLLSLGLLAGLLPALAACPQNCHCHSDLQHVICDKVGLQKIPKVSEKTKLLNLQRNNFPVLAANSFRAMPNLVSLHLQHCQIREVAAGAFRGLKQLIYLYLSHNDIRVLRAGAFDDLTELTYLYLDHNKVTELPRGLLSPLVNLFILQLNNNKIRELRAGAFQGAKDLRWLYLSENALSSLQPGALDDVENLAKFHVDRNQLSSYPSAALSKLRVVEELKLSHNPLKSIPDNAFQSFGRYLETLWLDNTNLEKFSDGAFLGVTTLKHVHLENNRLNQLPSNFPFDSLETLALTNNPWKCTCQLRGLRRWLEAKASRPDATCASPAKFKGQHIRDTDAFRSCKFPTKRSKKAGRH

SEQ ID NO: 15088 - protein, 359 aa, Homo sapiens; identical to SEQ ID NO: 15087
  Payload ID: 2957
  Gene Symbol: CHAD
  Gene Name: chondroadherin
  Uniprot ID: O15335
  ENSP ID: ENSP00000423812

SEQ ID NO: 15089 - protein, 42 aa, Homo sapiens
  Payload ID: 2957
  Gene Symbol: CHAD
  Gene Name: chondroadherin
  ENSP ID: ENSP00000425672
  MOD_RES (1)..(1): Any amino acid
XASRPDATCASPAKFKGQHIRDTDAFRSCKFPTKRSKKAGRH

SEQ ID NO: 15090 - protein, 762 aa, Homo sapiens
  Payload ID: 2958
  Gene Symbol: CHADL
  Gene Name: chondroadherin-like
  Uniprot ID: Q6NUI6
  ENSP ID: ENSP00000216241
MEGPRSSTHVPLVLPLLVLLLLAPARQAAAQRCPQACICDNSRRHVACRYQNLTEVPDAIPELTQRLDLQGNLLKVIPAAAFQGVPHLTHLDLRHCEVELVAEGAFRGLGRLLLLNLASNHLRELPQEALDGLGSLRRLELEGNALEELRPGTFGALGALATLNLAHNALVYLPAMAFQGLLRVRWLRLSHNALSVLAPEALAGLPALRRLSLHHNELQALPGPVLSQARGLARLELGHNPLTYAGEEDGLALPGLRELLLDGGALQALGPRAFAHCPRLHTLDLRGNQLDTLPPLQGPGQLRRLRLQGNPLWCGCQARPLLEWLARARVRSDGACQGPRRLRGEALDALRPWDLRCPGDAAQEEEELEERAVAGPRAPPRGPPRGPGEERAVAPCPRACVCVPESRHSSCEGCGLQAVPRGFPSDTQLLDLRRNHFPSVPRAAFPGLGHLVSLHLQHCGIAELEAGALAGLGRLIYLYLSDNQLAGLSAAALEGAPRLGYLYLERNRFLQVPGAALRALPSLFSLHLQDNAVDRLAPGDLGRTRALRWVYLSGNRITEVSLGALGPARELEKLHLDRNQLREVPTGALEGLPALLELQLSGNPLRALRDGAFQPVGRSLQHLFLNSSGLEQICPGAFSGLGPGLQSLHLQKNQLRALPALPSLSQLELIDLSSNPFHCDCQLLPLHRWLTGLNLRVGATCATPPNARGQRVKAAAAVFEDCPGWAARKAKRTPASRPSARRTPIKGRQCGADKVGKEKGRL

SEQ ID NO: 15091 - protein, 684 aa, Homo sapiens
  Payload ID: 2958
  Gene Symbol: CHADL
  Gene Name: chondroadherin-like
  ENSP ID: ENSP00000392046
  MOD_RES (1)..(1): Any amino acid
XPRSSTHVPLVLPLLVLLLLAPARQAAAQRCPQACICDNSRRHVACRYQNLTEVPDAIPELTQRLDLQGNLLKVIPAAAFQGVPHLTHLDLRHCEVELVAEGAFRGLGRLLLLNLASNHLRELPQEALDGLGSLRRLELEGNALEELRPGTFGALGALATLNLAHNALVYLPAMAFQGLLRVRWLRLSHNALSVLAPEALAGLPALRRLSLHHNELQALPGPVLSQARGLARLELGHNPLTYAGEEDGLALPGLRELLLDGGALQALGPRAFAHCPRLHTLDLRGNQLDTLPPLQGPGQLRRLRLQGNPLWCGCQARPLLEWLARARVRSDGACQGPRRLRGEALDALRPWDLRCPGDAAQEEEELEERAVAGPRAPPRGPPRGPGEERAVAPCPRACVCVPESRHSSCEGCGLQAVPRGFPSDTQLLDLRRNHFPSVPRAAFPGLGHLVSLHLQHCGIAELEAGALAGLGRLIYLYLSDNQLAGLSAAALEGAPRLGYLYLERNRFLQVPGAALRALPSLFSLHLQDNAVDRLAPGDLGRTRALRWVYLSGNRITEVSLGALGPARELEKLHLDRNQLREVPTGALEGLPALLELQLSGNPLRALRDGAFQPVGRSLQHLFLNSSGLEQICPGAFSGLGPGLQSLHLQKNQLRALPALPSARRTPIKGRQCGADKVGKEKGRL

SEQ ID NO: 15092 - protein, 252 aa, Homo sapiens
  Payload ID: 2958
  Gene Symbol: CHADL
  Gene Name: chondroadherin-like
  ENSP ID: ENSP00000412359
SSRRHGGVSLWARWCKGGFRAAQWPQDNAVDRLAPGDLGRTRALRWVYLSGNRITEVSLGALGPARELEKLHLDRNQLREVPTGALEGLPALLELQLSGNPLRALRDGAFQPVGRSLQHLFLNSSGLEQICPGAFSGLGPGLQSLHLQKNQLRALPALPSLSQLELIDLSSNPFHCDCQLLPLHRWLTGLNLRVGATCATPPNARGQRVKAAAAVFEDCPGWAARKAKRTPASRPSARRTPIKGRQCGADKV

SEQ ID NO: 15093 - protein, 775 aa, Homo sapiens
  Payload ID: 2959
  Gene Symbol: CHPF
  Gene Name: chondroitin polymerizing factor
  Uniprot ID: Q8IZ52
  ENSP ID: ENSP00000243776
MRASLLLSVLRPAGPVAVGISLGFTLSLLSVTWVEEPCGPGPPQPGDSELPPRGNTNAARRPNSVQPGAEREKPGAGEGAGENWEPRVLPYHPAQPGQAAKKAVRTRYISTELGIRQRLLVAVLTSQTTLPTLGVAVNRTLGHRLERVVFLTGARGRRAPPGMAVVTLGEERPIGHLHLALRHLLEQHGDDFDWFFLVPDTTYTEAHGLARLTGHLSLASAAHLYLGRPQDFIGGEPTPGRYCHGGFGVLLSRMLLQQLRPHLEGCRNDIVSARPDEWLGRCILDATGVGCTGDHEGVHYSHLELSPGEPVQEGDPHFRSALTAHPVRDPVHMYQLHKAFARAELERTYQEIQELQWEIQNTSHLAVDGDQAAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 15094 - protein, 298 aa, Homo sapiens
  Payload ID: 2959
  Gene Symbol: CHPF
  Gene Name: chondroitin polymerizing factor
  ENSP ID: ENSP00000362998
MRASLLLSVLRPAGPVAVGISLGFTLSLLSVTWVEEPCGPGPPQPGDSELPPRGNTNAARRPNSVQPGAEREKPGAGEGAGENWEPRVLPYHPAQPGQAAKKAVRTRYISTELGIRQRLLVAVLTSQTTLPTLGVAVNRTLGHRLERVVFLTGARGRRAPPGMAVVTLGEERPIGHLHLALRHLLEQHGDDFDWFFLVPDTTYTEAHGLARLTGHLSLASAAHLYLGRPQDFIGGEPTPGRYCHGGFGVLLSRMLLQQLRPHLEGCRNDIVSARPDEWLGRCILDATGVGCTGDHEVG

SEQ ID NO: 15095 - protein, 613 aa, Homo sapiens
  Payload ID: 2959
  Gene Symbol: CHPF
  Gene Name: chondroitin polymerizing factor
  Uniprot ID: Q8IZ52
  ENSP ID: ENSP00000445571
MAVVTLGEERPIGHLHLALRHLLEQHGDDFDWFFLVPDTTYTEAHGLARLTGHLSLASAAHLYLGRPQDFIGGEPTPGRYCHGGFGVLLSRMLLQQLRPHLEGCRNDIVSARPDEWLGRCILDATGVGCTGDHEGVHYSHLELSPGEPVQEGDPHFRSALTAHPVRDPVHMYQLHKAFARAELERTYQEIQELQWEIQNTSHLAVDGDQAAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 15096 - protein, 772 aa, Homo sapiens
  Payload ID: 2960
  Gene Symbol: CHPF2
  Gene Name: chondroitin polymerizing  factor 2
  Uniprot ID: Q9P2E5
  ENSP ID: ENSP00000035307
MRLSSLLALLRPALPLILGLSLGCSLSLLRVSWIQGEGEDPCVEAVGERGGPQNPDSRARLDQSDEDFKPRIVPYYRDPNKPYKKVLRTRYIQTELGSRERLLVAVLTSRATLSTLAVAVNRTVAHHFPRLLYFTGQRGARAPAGMQVVSHGDERPAWLMSETLRHLHTHFGADYDWFFIMQDDTYVQAPRLAALAGHLSINQDLYLGRAEEFIGAGEQARYCHGGFGYLLSRSLLLRLRPHLDGCRGDILSARPDEWLGRCLIDSLGVGCVSQHQGQQYRSFELAKNRDPEKEGSSAFLSAFAVHPVSEGTLMYRLHKRFSALELERAYSEIEQLQAQIRNLTVLTPEGEAGLSWPVGLPAPFTPHSRFEVLGWDYFTEQHTFSCADGAPKCPLQGASRADVGDALETALEQLNRRYQPRLRFQKQRLLNGYRRFDPARGMEYTLDLLLECVTQRGHRRALARRVSLLRPLSRVEILPMPYVTEATRVQLVLPLLVAEAAAAPAFLEAFAANVLEPREHALLTLLLVYGPREGGRGAPDPFLGVKAAAAELERRYPGTRLAWLAVRAEAPSQVRLMDVVSKKHPVDTLFFLTTVWTRPGPEVLNRCRMNAISGWQAFFPVHFQEFNPALSPQRSPPGPPGAGPDPPSPPGADPSRGAPIGGRFDRQASAEGCFYNADYLAARARLAGELAGQEEEEALEGLEVMDVFLRFSGLHLFRAVEPGLVQKFSLRDCSPRLSEELYHRCRLSNLEGLGGRAQLAMALFEQEQANST

SEQ ID NO: 15097 - protein, 764 aa, Homo sapiens
  Payload ID: 2960
  Gene Symbol: CHPF2
  Gene Name: chondroitin polymerizing  factor 2
  ENSP ID: ENSP00000418914
MLSLARPPLPPTGLRTSLSLLRVSWIQGEGEDPCVEAVGERGGPQNPDSRARLDQSDEDFKPRIVPYYRDPNKPYKKVLRTRYIQTELGSRERLLVAVLTSRATLSTLAVAVNRTVAHHFPRLLYFTGQRGARAPAGMQVVSHGDERPAWLMSETLRHLHTHFGADYDWFFIMQDDTYVQAPRLAALAGHLSINQDLYLGRAEEFIGAGEQARYCHGGFGYLLSRSLLLRLRPHLDGCRGDILSARPDEWLGRCLIDSLGVGCVSQHQGQQYRSFELAKNRDPEKEGSSAFLSAFAVHPVSEGTLMYRLHKRFSALELERAYSEIEQLQAQIRNLTVLTPEGEAGLSWPVGLPAPFTPHSRFEVLGWDYFTEQHTFSCADGAPKCPLQGASRADVGDALETALEQLNRRYQPRLRFQKQRLLNGYRRFDPARGMEYTLDLLLECVTQRGHRRALARRVSLLRPLSRVEILPMPYVTEATRVQLVLPLLVAEAAAAPAFLEAFAANVLEPREHALLTLLLVYGPREGGRGAPDPFLGVKAAAAELERRYPGTRLAWLAVRAEAPSQVRLMDVVSKKHPVDTLFFLTTVWTRPGPEVLNRCRMNAISGWQAFFPVHFQEFNPALSPQRSPPGPPGAGPDPPSPPGADPSRGAPIGGRFDRQASAEGCFYNADYLAARARLAGELAGQEEEEALEGLEVMDVFLRFSGLHLFRAVEPGLVQKFSLRDCSPRLSEELYHRCRLSNLEGLGGRAQLAMALFEQEQANST

SEQ ID NO: 15098 - protein, 90 aa, Homo sapiens
  Payload ID: 2960
  Gene Symbol: CHPF2
  Gene Name: chondroitin polymerizing  factor 2
  ENSP ID: ENSP00000419769
MLSLARPPLPPTGLRTRTRYIQTELGSRERLLVAVLTSRATLSTLAVAVNRTVAHHFPRLLYFTGQRGARAPAGMQVVSHGDERPAWLMS

SEQ ID NO: 15099 - protein, 123 aa, Homo sapiens
  Payload ID: 2960
  Gene Symbol: CHPF2
  Gene Name: chondroitin polymerizing  factor 2
  ENSP ID: ENSP00000420204
CHGGFGYLLSRSLLLRLRPHLDGCRGDILSARPDEWLGRCLIDSLGVGCVSQHQGQQYRSFELAKNRDPEKEGSSAFLSAFAVHPVSEGTLMYRLHKRFSALELERAYSEIEQLQNCPKKAQG

SEQ ID NO: 15100 - protein, 532 aa, Homo sapiens
  Payload ID: 2961
  Gene Symbol: CSGALNACT1
  Gene Name: chondroitin sulfate N-acetylgalactosaminyltransferase 1
  Uniprot ID: Q8TDX6
  ENSP ID: ENSP00000330805
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNSPAENSPNHRPYTASDFIEGIYRTERDKGTLYELTFKGDHKHEFKRLILFRPFGPIMKVKNEKLNMANTLINVIVPLAKRVDKFRQFMQNFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 15101 - protein, 297 aa, Homo sapiens
  Payload ID: 2961
  Gene Symbol: CSGALNACT1
  Gene Name: chondroitin sulfate N-acetylgalactosaminyltransferase 1
  Uniprot ID: Q8TDX6
  ENSP ID: ENSP00000381084
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNSPAENSPNHRPYTASDFIEGIYRTERDKGTLYELTFKGDHKHEFKRLILFRPFGPIMKVKNEKLNMANTLINVIVPLAKRVDKFRQFMQNFRPADEVFRCVPLSP

SEQ ID NO: 15102 - protein, 532 aa, Homo sapiens; identical to SEQ ID NO: 15100
  Payload ID: 2961
  Gene Symbol: CSGALNACT1
  Gene Name: chondroitin sulfate N-acetylgalactosaminyltransferase 1
  Uniprot ID: Q8TDX6
  ENSP ID: ENSP00000411816

SEQ ID NO: 15103 - protein, 14 aa, Homo sapiens
  Payload ID: 2961
  Gene Symbol: CSGALNACT1
  Gene Name: chondroitin sulfate N-acetylgalactosaminyltransferase 1
  ENSP ID: ENSP00000427740
MMMVRRGLLAWISR

SEQ ID NO: 15104 - protein, 104 aa, Homo sapiens
  Payload ID: 2961
  Gene Symbol: CSGALNACT1
  Gene Name: chondroitin sulfate N-acetylgalactosaminyltransferase 1
  ENSP ID: ENSP00000428089
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAA

SEQ ID NO: 15105 - protein, 297 aa, Homo sapiens; identical to SEQ ID NO: 15101
  Payload ID: 2961
  Gene Symbol: CSGALNACT1
  Gene Name: chondroitin sulfate N-acetylgalactosaminyltransferase 1
  Uniprot ID: Q8TDX6
  ENSP ID: ENSP00000428216

SEQ ID NO: 15106 - protein, 53 aa, Homo sapiens
  Payload ID: 2961
  Gene Symbol: CSGALNACT1
  Gene Name: chondroitin sulfate N-acetylgalactosaminyltransferase 1
  ENSP ID: ENSP00000428774
MMMVRRGLLAWISRVVVLLVLLCCAISVLYMLACTPKGDEEQLALPRANSPTG

SEQ ID NO: 15107 - protein, 96 aa, Homo sapiens
  Payload ID: 2961
  Gene Symbol: CSGALNACT1
  Gene Name: chondroitin sulfate N-acetylgalactosaminyltransferase 1
  ENSP ID: ENSP00000429130
MMMVRRGLLAWISRVVVLLVLLCCAISVLYMLACTPKGDEEQLALPRANSPTGKEGYQAVLQEWEEQHRNYVSSLKRQIAQLKEELQERSEQLRNG

SEQ ID NO: 15108 - protein, 532 aa, Homo sapiens; identical to SEQ ID NO: 15100
  Payload ID: 2961
  Gene Symbol: CSGALNACT1
  Gene Name: chondroitin sulfate N-acetylgalactosaminyltransferase 1
  Uniprot ID: Q8TDX6
  ENSP ID: ENSP00000429809

SEQ ID NO: 15109 - protein, 542 aa, Homo sapiens
  Payload ID: 2962
  Gene Symbol: CSGALNACT2
  Gene Name: chondroitin sulfate N-acetylgalactosaminyltransferase 2
  Uniprot ID: Q8N6G5
  ENSP ID: ENSP00000363590
MPRRGLILHTRTHWLLLGLALLCSLVLFMYLLECAPQTDGNASLPGVVGENYGKEYYQALLQEQEEHYQTRATSLKRQIAQLKQELQEMSEKMRSLQERRNVGANGIGYQSNKEQAPSDLLEFLHSQIDKAEVSIGAKLPSEYGVIPFESFTLMKVFQLEMGLTRHPEEKPVRKDKRDELVEVIEAGLEVINNPDEDDEQEDEEGPLGEKLIFNENDFVEGYYRTERDKGTQYELFFKKADLTEYRHVTLFRPFGPLMKVKSEMIDITRSIINIIVPLAERTEAFVQFMQNFRDVCIHQDKKIHLTVVYFGKEGLSKVKSILESVTSESNFHNYTLVSLNEEFNRGRGLNVGARAWDKGEVLMFFCDVDIYFSAEFLNSCRLNAEPGKKVFYPVVFSLYNPAIVYANQEVPPPVEQQLVHKKDSGFWRDFGFGMTCQYRSDFLTIGGFDMEVKGWGGEDVHLYRKYLHGDLIVIRTPVPGLFHLWHEKRCADELTPEQYRMCIQSKAMNEASHSHLGMLVFREEIETHLHKQAYRTNSEAVG

SEQ ID NO: 15110 - protein, 2322 aa, Homo sapiens
  Payload ID: 2963
  Gene Symbol: CSPG4
  Gene Name: chondroitin sulfate proteoglycan 4
  Uniprot ID: Q6UVK1
  ENSP ID: ENSP00000312506
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 15111 - protein, 539 aa, Homo sapiens
  Payload ID: 2964
  Gene Symbol: CSPG5
  Gene Name: chondroitin sulfate proteoglycan 5 (neuroglycan C)
  Uniprot ID: O95196
  ENSP ID: ENSP00000264723
MGRAGGGGPGRGPPPLLLFLGAALVLASGAVPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNDDPSAPHKIQEVLKSCLKEEESFNIQNSMSPKLEGGKGDQADLDVNCLQNNLT

SEQ ID NO: 15112 - protein, 566 aa, Homo sapiens
  Payload ID: 2964
  Gene Symbol: CSPG5
  Gene Name: chondroitin sulfate proteoglycan 5 (neuroglycan C)
  Uniprot ID: O95196
  ENSP ID: ENSP00000373244
MGRAGGGGPGRGPPPLLLFLGAALVLASGAVPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNVRKLCNTPRTSSPHARALAHYDNVICQDDPSAPHKIQEVLKSCLKEEESFNIQNSMSPKLEGGKGDQADLDVNCLQNNLT

SEQ ID NO: 15113 - protein, 401 aa, Homo sapiens
  Payload ID: 2964
  Gene Symbol: CSPG5
  Gene Name: chondroitin sulfate proteoglycan 5 (neuroglycan C)
  Uniprot ID: O95196
  ENSP ID: ENSP00000392096
MPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNDDPSAPHKIQEVLKSCLKEEESFNIQNSMSPKLEGGKGDQADLDVNCLQNNLT

SEQ ID NO: 15114 - protein, 477 aa, Homo sapiens
  Payload ID: 2964
  Gene Symbol: CSPG5
  Gene Name: chondroitin sulfate proteoglycan 5 (neuroglycan C)
  ENSP ID: ENSP00000478923
MGRAGGGGPGRGPPPLLLFLGAALVLASGAVPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTKMILVLPTKSRRFSSPA

SEQ ID NO: 15115 - protein, 802 aa, Homo sapiens
  Payload ID: 2965
  Gene Symbol: CHSY1
  Gene Name: chondroitin sulfate synthase 1
  Uniprot ID: Q86X52
  ENSP ID: ENSP00000254190
MAARGRRAWLSVLLGLVLGFVLASRLVLPRASELKRAGPRRRASPEGCRSGQAAASQAGGARGDARGAQLWPPGSDPDGGPRDRNFLFVGVMTAQKYLQTRAVAAYRTWSKTIPGKVQFFSSEGSDTSVPIPVVPLRGVDDSYPPQKKSFMMLKYMHDHYLDKYEWFMRADDDVYIKGDRLENFLRSLNSSEPLFLGQTGLGTTEEMGKLALEPGENFCMGGPGVIMSREVLRRMVPHIGKCLREMYTTHEDVEVGRCVRRFAGVQCVWSYEMQQLFYENYEQNKKGYIRDLHNSKIHQAITLHPNKNPPYQYRLHSYMLSRKISELRHRTIQLHREIVLMSKYSNTEIHKEDLQLGIPPSFMRFQPRQREEILEWEFLTGKYLYSAVDGQPPRRGMDSAQREALDDIVMQVMEMINANAKTRGRIIDFKEIQYGYRRVNPMYGAEYILDLLLLYKKHKGKKMTVPVRRHAYLQQTFSKIQFVEHEELDAQELAKRINQESGSLSFLSNSLKKLVPFQLPGSKSEHKEPKDKKINILIPLSGRFDMFVRFMGNFEKTCLIPNQNVKLVVLLFNSDSNPDKAKQVELMRDYRIKYPKADMQILPVSGEFSRALALEVGSSQFNNESLLFFCDVDLVFTTEFLQRCRANTVLGQQIYFPIIFSQYDPKIVYSGKVPSDNHFAFTQKTGFWRNYGFGITCIYKGDLVRVGGFDVSIQGWGLEDVDLFNKVVQAGLKTFRSQEVGVVHVHHPVFCDPNLDPKQYKMCLGSKASTYGSTQQLAEMWLEKNDPSYSKSSNNNGSVRTA

SEQ ID NO: 15116 - protein, 882 aa, Homo sapiens
  Payload ID: 2966
  Gene Symbol: CHSY3
  Gene Name: chondroitin sulfate synthase 3
  Uniprot ID: Q70JA7
  ENSP ID: ENSP00000302629
MAVRSRRPWMSVALGLVLGFTAASWLIAPRVAELSERKRRGSSLCSYYGRSAAGPRAGAQQPLPQPQSRPRQEQSPPPARQDLQGPPLPEAAPGITSFRSSPWQQPPPLQQRRRGREPEGATGLPGAPAAEGEPEEEDGGAAGQRRDGRPGSSHNGSGDGGAAAPSARPRDFLYVGVMTAQKYLGSRALAAQRTWARFIPGRVEFFSSQQPPNAGQPPPPLPVIALPGVDDSYPPQKKSFMMIKYMHDHYLDKYEWFMRADDDVYIKGDKLEEFLRSLNSSKPLYLGQTGLGNIEELGKLGLEPGENFCMGGPGMIFSREVLRRMVPHIGECLREMYTTHEDVEVGRCVRRFGGTQCVWSYEMQQLFHENYEHNRKGYIQDLHNSKIHAAITLHPNKRPAYQYRLHNYMLSRKISELRYRTIQLHRESALMSKLSNTEVSKEDQQLGVIPSFNHFQPRERNEVIEWEFLTGKLLYSAAENQPPRQSLSSILRTALDDTVLQVMEMINENAKSRGRLIDFKEIQYGYRRVNPMHGVEYILDLLLLYKRHKGRKLTVPVRRHAYLQQLFSKPFFRETEELDVNSLVESINSETQSFSFISNSLKILSSFQGAKEMGGHNEKKVHILVPLIGRYDIFLRFMENFENMCLIPKQNVKLVIILFSRDSGQDSSKHIELIKGYQNKYPKAEMTLIPMKGEFSRGLGLEMASAQFDNDTLLLFCDVDLIFREDFLQRCRDNTIQGQQVYYPIIFSQYDPKVTNGGNPPTDDYFIFSKKTGFWRDYGYGITCIYKSDLLGAGGFDTSIQGWGLEDVDLYNKVILSGLRPFRSQEVGVVHIFHPVHCDPNLDPKQYKMCLGSKASTFASTMQLAELWLEKHLGVRYNRTLS

SEQ ID NO: 15117 - protein, 273 aa, Homo sapiens
  Payload ID: 2967
  Gene Symbol: CHODL
  Gene Name: chondrolectin
  Uniprot ID: Q9H9P2
  ENSP ID: ENSP00000299295
MSRVVSLLLGAALLCGHGAFCRRVVSGQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 15118 - protein, 236 aa, Homo sapiens
  Payload ID: 2967
  Gene Symbol: CHODL
  Gene Name: chondrolectin
  ENSP ID: ENSP00000339975
MAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAVKEEQKLVQTSLHCGFQRVPEKKVAWKYNNSLTWFQNFVILDLYKEWHQNNSLEWLEITKDLQDEL

SEQ ID NO: 15119 - protein, 232 aa, Homo sapiens
  Payload ID: 2967
  Gene Symbol: CHODL
  Gene Name: chondrolectin
  Uniprot ID: Q9H9P2
  ENSP ID: ENSP00000382992
MAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 15120 - protein, 232 aa, Homo sapiens; identical to SEQ ID NO: 15119
  Payload ID: 2967
  Gene Symbol: CHODL
  Gene Name: chondrolectin
  Uniprot ID: Q9H9P2
  ENSP ID: ENSP00000382993

SEQ ID NO: 15121 - protein, 236 aa, Homo sapiens; identical to SEQ ID NO: 15118
  Payload ID: 2967
  Gene Symbol: CHODL
  Gene Name: chondrolectin
  ENSP ID: ENSP00000382996

SEQ ID NO: 15122 - protein, 236 aa, Homo sapiens; identical to SEQ ID NO: 15118
  Payload ID: 2967
  Gene Symbol: CHODL
  Gene Name: chondrolectin
  ENSP ID: ENSP00000383001

SEQ ID NO: 15123 - protein, 254 aa, Homo sapiens
  Payload ID: 2967
  Gene Symbol: CHODL
  Gene Name: chondrolectin
  Uniprot ID: Q9H9P2
  ENSP ID: ENSP00000443566
MTAGSAHSQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 15124 - protein, 27 aa, Homo sapiens
  Payload ID: 2968
  Gene Symbol: CSAG1
  Gene Name: chondrosarcoma associated gene 1
  ENSP ID: ENSP00000354898
MSATTVSSLLACLHCPGGSSGRPGGLE

SEQ ID NO: 15125 - protein, 78 aa, Homo sapiens
  Payload ID: 2968
  Gene Symbol: CSAG1
  Gene Name: chondrosarcoma associated gene 1
  ENSP ID: ENSP00000359310
MSATTACWPAFTVLGEARGDQVDWSRLYRDTGLVKMSRKPRASSPFSNNHPSTPKRFPRQPRREKGPVKEVPGTKGSP

SEQ ID NO: 15126 - protein, 73 aa, Homo sapiens
  Payload ID: 2968
  Gene Symbol: CSAG1
  Gene Name: chondrosarcoma associated gene 1
  Uniprot ID: Q6PB30
  ENSP ID: ENSP00000359314
MSATTACWPAFTVLGEARGDQVDWSRLYRDTGLVKMSRKPRASSPFSNNHPSTPKRRGRGKHPLIPGPEALSK

SEQ ID NO: 15127 - protein, 78 aa, Homo sapiens; identical to SEQ ID NO: 15125
  Payload ID: 2968
  Gene Symbol: CSAG1
  Gene Name: chondrosarcoma associated gene 1
  ENSP ID: ENSP00000396520

SEQ ID NO: 15128 - protein, 955 aa, Homo sapiens
  Payload ID: 2969
  Gene Symbol: CHRD
  Gene Name: chordin
  Uniprot ID: Q9H2X0
  ENSP ID: ENSP00000204604
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 15129 - protein, 915 aa, Homo sapiens
  Payload ID: 2969
  Gene Symbol: CHRD
  Gene Name: chordin
  Uniprot ID: Q9H2X0
  ENSP ID: ENSP00000334036
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 15130 - protein, 86 aa, Homo sapiens
  Payload ID: 2969
  Gene Symbol: CHRD
  Gene Name: chordin
  Uniprot ID: Q9H2X0
  ENSP ID: ENSP00000348930
MPSLPAPPAPLLLLGLLLLGSRPARGAGPEPPVLPIRSEKEPLPVRGAAGCTFGGKVYALDETWHPDLGEPFGVMRCVLCACEAGP

SEQ ID NO: 15131 - protein, 350 aa, Homo sapiens
  Payload ID: 2969
  Gene Symbol: CHRD
  Gene Name: chordin
  Uniprot ID: Q9H2X0
  ENSP ID: ENSP00000392794
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGDSTPGAATARTSGQCLSPGTRLC

SEQ ID NO: 15132 - protein, 94 aa, Homo sapiens
  Payload ID: 2969
  Gene Symbol: CHRD
  Gene Name: chordin
  Uniprot ID: Q9H2X0
  ENSP ID: ENSP00000408624
MPSLPAPPAPLLLLGLLLLGSRPARGAGPEPPVLPIRSEKEPLPVRGAAGCTFGGKVYALDETWHPDLGEPFGVMRCVLCACEATGTLRPREMK

SEQ ID NO: 15133 - protein, 954 aa, Homo sapiens
  Payload ID: 2969
  Gene Symbol: CHRD
  Gene Name: chordin
  ENSP ID: ENSP00000408972
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPPETRTDPELEKEAEGS

SEQ ID NO: 15134 - protein, 458 aa, Homo sapiens
  Payload ID: 2970
  Gene Symbol: CHRDL1
  Gene Name: chordin-like 1
  Uniprot ID: Q9BU40
  ENSP ID: ENSP00000361112
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPEDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 15135 - protein, 450 aa, Homo sapiens
  Payload ID: 2970
  Gene Symbol: CHRDL1
  Gene Name: chordin-like 1
  Uniprot ID: Q9BU40
  ENSP ID: ENSP00000361115
MGGMKYIFSLLFFLLLEGGKTEQVKHSETYCMFQDKKYRVGERWHPYLEPYGLVYCVNCICSENGNVLCSRVRCPNVHCLSPVHIPHLCCPRCPDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 15136 - protein, 456 aa, Homo sapiens
  Payload ID: 2970
  Gene Symbol: CHRDL1
  Gene Name: chordin-like 1
  Uniprot ID: Q9BU40
  ENSP ID: ENSP00000378276
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 15137 - protein, 457 aa, Homo sapiens
  Payload ID: 2970
  Gene Symbol: CHRDL1
  Gene Name: chordin-like 1
  Uniprot ID: Q9BU40
  ENSP ID: ENSP00000399739
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 15138 - protein, 378 aa, Homo sapiens
  Payload ID: 2970
  Gene Symbol: CHRDL1
  Gene Name: chordin-like 1
  Uniprot ID: Q9BU40
  ENSP ID: ENSP00000418443
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 15139 - protein, 451 aa, Homo sapiens
  Payload ID: 2971
  Gene Symbol: CHRDL2
  Gene Name: chordin-like 2
  Uniprot ID: Q6WN34
  ENSP ID: ENSP00000263671
MVPEVRVLSSLLGLALLWFPLDSHARARPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTEGQIYCGLTTCPEPGCPAPLPLPDSCCQACKDEASEQSDEEDSVQSLHGVRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKDEETEAQRGEVPGPRPHSQNLPLDSDQESQEARLPERGTALPTARWPPRRSLERLPSPDPGAEGHGQSRQSDQDITKT

SEQ ID NO: 15140 - protein, 142 aa, Homo sapiens
  Payload ID: 2971
  Gene Symbol: CHRDL2
  Gene Name: chordin-like 2
  ENSP ID: ENSP00000365502
MALVGLPGPDMFCLFHGKRYSPGESWHPYLEPQGLMYCLRCTCSENLTLPLDSGPHQSPASTTGPCTNTERSSVPMSCSPPACPTSVSSAAAQRARSTAASQPAPNQAAQHPSRCQTPAARPAKMRQVSNRMKRTVCSRSMG

SEQ ID NO: 15141 - protein, 429 aa, Homo sapiens
  Payload ID: 2971
  Gene Symbol: CHRDL2
  Gene Name: chordin-like 2
  Uniprot ID: Q6WN34
  ENSP ID: ENSP00000365510
MVPEVRVLSSLLGLALLWFPLDSHARARPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTEGQIYCGLTTCPEPGCPAPLPLPDSCCQACKDEASEQSDEEDSVQSLHGVRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKGIFHLTQIKKVRKQDFQKEAQHFRLLAGPHEGHWNVFLAQTLELKVTASPDKVTKT

SEQ ID NO: 15142 - protein, 308 aa, Homo sapiens
  Payload ID: 2971
  Gene Symbol: CHRDL2
  Gene Name: chordin-like 2
  ENSP ID: ENSP00000431380
MVPEVRVLSSLLGLALLWFPLDSHARARPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTEGQIYCGLTTCPEPGCPAPLPLPDSCCQACKDEASEQSDEEDSVQSLHGVRHPQDPCSSDAGRKRGPGTPAPTGLSAPLSFIPRHFRPKGAGSTTVKIVLKEKHKKEDKADPGHSEISSTRCPKAPGRVLVHTSVSPSPDNLRRFALEHEASDLVEIYLWKLVK

SEQ ID NO: 15143 - protein, 142 aa, Homo sapiens
  Payload ID: 2971
  Gene Symbol: CHRDL2
  Gene Name: chordin-like 2
  Uniprot ID: Q6WN34
  ENSP ID: ENSP00000432055
MALVGLPGPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTMRQVSNRMKRTVCSRSMG

SEQ ID NO: 15144 - protein, 91 aa, Homo sapiens
  Payload ID: 2971
  Gene Symbol: CHRDL2
  Gene Name: chordin-like 2
  ENSP ID: ENSP00000432345
  MOD_RES (1)..(1): Any amino acid
XGDRSRISKENRQKKTGFTVEATGRQGRGMTGNLPLDSDQESQEARLPERGTALPTARWPPRRSLERLPSPDPGAEGHGQSRQSDQDITKT

SEQ ID NO: 15145 - protein, 177 aa, Homo sapiens
  Payload ID: 2971
  Gene Symbol: CHRDL2
  Gene Name: chordin-like 2
  ENSP ID: ENSP00000434257
  MOD_RES (1)..(1): Any amino acid
XSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVTGTSS

SEQ ID NO: 15146 - protein, 93 aa, Homo sapiens
  Payload ID: 2971
  Gene Symbol: CHRDL2
  Gene Name: chordin-like 2
  Uniprot ID: Q6WN34
  ENSP ID: ENSP00000434589
MALVGLPGPDMFCLFHGKRYSPGESWHPYLEPQGLMYCLRCTCSENLTLPLDSGPHQSPASTTGPCTNTERSSVPMSCSPPACPTSVSSAAAQ

SEQ ID NO: 15147 - protein, 281 aa, Homo sapiens [sequence omitted]

SEQ ID NO: 15148 - protein, 165 aa, Homo sapiens
  Payload ID: 2972
  Gene Symbol: CGB
  Gene Name: chorionic gonadotropin, beta polypeptide
  Uniprot ID: P01233
  ENSP ID: ENSP00000349954
MEMFQGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 15149 - protein, 155 aa, Homo sapiens
  Payload ID: 2973
  Gene Symbol: CGB1
  Gene Name: chorionic gonadotropin, beta polypeptide 1
  Uniprot ID: A6NKQ9
  ENSP ID: ENSP00000301407
MSKRLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGP

SEQ ID NO: 15150 - protein, 129 aa, Homo sapiens
  Payload ID: 2973
  Gene Symbol: CGB1
  Gene Name: chorionic gonadotropin, beta polypeptide 1
  ENSP ID: ENSP00000472896
MGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKA

SEQ ID NO: 15151 - protein, 163 aa, Homo sapiens
  Payload ID: 2974
  Gene Symbol: CGB2
  Gene Name: chorionic gonadotropin, beta polypeptide 2
  ENSP ID: ENSP00000352295
MSKGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQ

SEQ ID NO: 15152 - protein, 129 aa, Homo sapiens
  Payload ID: 2974
  Gene Symbol: CGB2
  Gene Name: chorionic gonadotropin, beta polypeptide 2
  ENSP ID: ENSP00000471177
MGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKA

SEQ ID NO: 15153 - protein, 165 aa, Homo sapiens; identical to SEQ ID NO: 15148
  Payload ID: 2975
  Gene Symbol: CGB5
  Gene Name: chorionic gonadotropin, beta polypeptide 5
  Uniprot ID: P01233
  ENSP ID: ENSP00000301408

SEQ ID NO: 15154 - protein, 165 aa, Homo sapiens
  Payload ID: 2976
  Gene Symbol: CGB7
  Gene Name: chorionic gonadotropin, beta polypeptide 7
  Uniprot ID: P01233
  ENSP ID: ENSP00000366493
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQ

SEQ ID NO: 15155 - protein, 165 aa, Homo sapiens; identical to SEQ ID NO: 15154
  Payload ID: 2976
  Gene Symbol: CGB7
  Gene Name: chorionic gonadotropin, beta polypeptide 7
  Uniprot ID: P01233
  ENSP ID: ENSP00000469076

SEQ ID NO: 15156 - protein, 165 aa, Homo sapiens; identical to SEQ ID NO: 15154
  Payload ID: 2976
  Gene Symbol: CGB7
  Gene Name: chorionic gonadotropin, beta polypeptide 7
  Uniprot ID: P01233
  ENSP ID: ENSP00000470813

SEQ ID NO: 15157 - protein, 165 aa, Homo sapiens; identical to SEQ ID NO: 15148
  Payload ID: 2977
  Gene Symbol: CGB8
  Gene Name: chorionic gonadotropin, beta polypeptide 8
  Uniprot ID: P01233
  ENSP ID: ENSP00000403649

SEQ ID NO: 15158 - protein, 217 aa, Homo sapiens
  Payload ID: 2978
  Gene Symbol: CSH1
  Gene Name: chorionic somatomammotropin hormone 1 (placental lactogen)
  Uniprot ID: P0DML2
  ENSP ID: ENSP00000316416
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 15159 - protein, 256 aa, Homo sapiens
  Payload ID: 2978
  Gene Symbol: CSH1
  Gene Name: chorionic somatomammotropin hormone 1 (placental lactogen)
  ENSP ID: ENSP00000333268
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGVRVAPGVTNPGTPLASRAGGEKYCCPLFSSKALTQENSPYSSFRLVNPPGLSLHPEGEGGKWINERGREQCPSAWPLLLFLHFAEAGRRQPPDWADPQADLQQV

SEQ ID NO: 15160 - protein, 122 aa, Homo sapiens
  Payload ID: 2978
  Gene Symbol: CSH1
  Gene Name: chorionic somatomammotropin hormone 1 (placental lactogen)
  ENSP ID: ENSP00000402517
MAPGSRTSLLLAFALLCLPWLQEAGAVQTVPLSRLFDHAMLQAHRAHQLAIDTYQEFRLEDGSRRTGQILKQTYSKFDTNSHNHDALLKNYGLLYCFRKDMDKVETFLRMVQCRSVEGSCGF

SEQ ID NO: 15161 - protein, 128 aa, Homo sapiens
  Payload ID: 2978
  Gene Symbol: CSH1
  Gene Name: chorionic somatomammotropin hormone 1 (placental lactogen)
  ENSP ID: ENSP00000478652
MEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 15162 - protein, 122 aa, Homo sapiens
  Payload ID: 2979
  Gene Symbol: CSH2
  Gene Name: chorionic somatomammotropin hormone 2
  Uniprot ID: P0DML3
  ENSP ID: ENSP00000308396
MAAGSRTSLLLAFALLCLPWLQEAGAVQTVPLSRLFDHAMLQAHRAHQLAIDTYQEFRLEDGSRRTGQILKQTYSKFDTNSHNHDALLKNYGLLYCFRKDMDKVETFLRMVQCRSVEGSCGF

SEQ ID NO: 15163 - protein, 167 aa, Homo sapiens
  Payload ID: 2979
  Gene Symbol: CSH2
  Gene Name: chorionic somatomammotropin hormone 2
  Uniprot ID: P0DML3
  ENSP ID: ENSP00000338816
MAAGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGVRVAPGVANPGTPLA

SEQ ID NO: 15164 - protein, 217 aa, Homo sapiens
  Payload ID: 2979
  Gene Symbol: CSH2
  Gene Name: chorionic somatomammotropin hormone 2
  Uniprot ID: P0DML3
  ENSP ID: ENSP00000376623
MAAGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 15165 - protein, 160 aa, Homo sapiens
  Payload ID: 2979
  Gene Symbol: CSH2
  Gene Name: chorionic somatomammotropin hormone 2
  ENSP ID: ENSP00000453452
MAAGSRTSLLLAFALLCLPWLQEADSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 15166 - protein, 128 aa, Homo sapiens; identical to SEQ ID NO: 15161
  Payload ID: 2979
  Gene Symbol: CSH2
  Gene Name: chorionic somatomammotropin hormone 2
  ENSP ID: ENSP00000478842

SEQ ID NO: 15167 - protein, 222 aa, Homo sapiens
  Payload ID: 2979
  Gene Symbol: CSH2
  Gene Name: chorionic somatomammotropin hormone 2
  ENSP ID: ENSP00000480793
MAAGSRTSLLLAFALLCLPWLQEAGAVQTVPLSRLFDHAMLQAHRAHQLAIDTYQEFVSSWGMETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 15168 - protein, 160 aa, Homo sapiens
  Payload ID: 2980
  Gene Symbol: CSHL1
  Gene Name: chorionic somatomammotropin hormone-like 1
  ENSP ID: ENSP00000259003
MAAGSRTSLLLAFALLCLPWLQEADSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 15169 - protein, 222 aa, Homo sapiens
  Payload ID: 2980
  Gene Symbol: CSHL1
  Gene Name: chorionic somatomammotropin hormone-like 1
  Uniprot ID: Q14406
  ENSP ID: ENSP00000309524
MAAGSRTSLLLAFALLCLPWLQEAGAVQTVPLSRLFKEAMLQAHRAHQLAIDTYQEFISSWGMEAYITKEQKYSFLHDSQTSFCFSDSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 15170 - protein, 128 aa, Homo sapiens
  Payload ID: 2980
  Gene Symbol: CSHL1
  Gene Name: chorionic somatomammotropin hormone-like 1
  Uniprot ID: Q14406
  ENSP ID: ENSP00000316360
MEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 15171 - protein, 217 aa, Homo sapiens [sequence omitted]

SEQ ID NO: 15172 - protein, 139 aa, Homo sapiens
  Payload ID: 2980
  Gene Symbol: CSHL1
  Gene Name: chorionic somatomammotropin hormone-like 1
  Uniprot ID: Q14406
  ENSP ID: ENSP00000402632
MAADSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 15173 - protein, 167 aa, Homo sapiens
  Payload ID: 2980
  Gene Symbol: CSHL1
  Gene Name: chorionic somatomammotropin hormone-like 1
  ENSP ID: ENSP00000413501
MEETQQKSNLELLHISLLLIESRLEPVRFLRSTFTNNLVYDTSDSDDYHLLKDLEEGIQMLMGVRVAPGVPNPGSPLASRAGGEKHCCPLFSSQALTQENSPYSSFPLVNPPGLSLHPEGEGGKWINERGREQCPSAWSLLLLLHFAEAGRRQPPDWADPQADLQQV

SEQ ID NO: 15174 - protein, 178 aa, Homo sapiens
  Payload ID: 2980
  Gene Symbol: CSHL1
  Gene Name: chorionic somatomammotropin hormone-like 1
  ENSP ID: ENSP00000452900
MAADSIPTSSNMEETQQKSNLELLHISLLLIESRLEPVRFLRSTFTNNLVYDTSDSDDYHLLKDLEEGIQMLMGVRVAPGVPNPGSPLASRAGGEKHCCPLFSSQALTQENSPYSSFPLVNPPGLSLHPEGEGGKWINERGREQCPSAWSLLLLLHFAEAGRRQPPDWADPQADLQQV

SEQ ID NO: 15175 - protein, 217 aa, Homo sapiens
  Payload ID: 2980
  Gene Symbol: CSHL1
  Gene Name: chorionic somatomammotropin hormone-like 1
  ENSP ID: ENSP00000483369
FSPGSRTSLLLAFALLCLPWLQEAGAVQTVPLSRLFKEAMLQAHRAHQLAIDTYQEVEEAYITKEQKYSFLHDSQTSFCFSDSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 15176 - protein, 653 aa, Homo sapiens
  Payload ID: 2981
  Gene Symbol: CHM
  Gene Name: choroideremia (Rab escort protein 1)
  Uniprot ID: P24386
  ENSP ID: ENSP00000350386
MADTLPSEFDVIVIGTGLPESIIAAACSRSGRRVLHVDSRSYYGGNWASFSFSGLLSWLKEYQENSDIVSDSPVWQDQILENEEAIALSRKDKTIQHVEVFCYASQDLHEDVEEAGALQKNHALVTSANSTEAADSAFLPTEDESLSTMSCEMLTEQTPSSDPENALEVNGAEVTGEKENHCDDKTCVPSTSAEDMSENVPIAEDTTEQPKKNRITYSQIIKEGRRFNIDLVSKLLYSRGLLIDLLIKSNVSRYAEFKNITRILAFREGRVEQVPCSRADVFNSKQLTMVEKRMLMKFLTFCMEYEKYPDEYKGYEEITFYEYLKTQKLTPNLQYIVMHSIAMTSETASSTIDGLKATKNFLHCLGRYGNTPFLFPLYGQGELPQCFCRMCAVFGGIYCLRHSVQCLVVDKESRKCKAIIDQFGQRIISEHFLVEDSYFPENMCSRVQYRQISRAVLITDRSVLKTDSDQQISILTVPAEEPGTFAVRVIELCSSTMTCMKGTYLVHLTCTSSKTAREDLESVVQKLFVPYTEMEIENEQVEKPRILWALYFNMRDSSDISRSCYNDLPSNVYVCSGPDCGLGNDNAVKQAETLFQEICPNEDFCPPPPNPEDIILDGDSLQPEASESSAIPEANSETFKESTNLGNLEESSE

SEQ ID NO: 15177 - protein, 110 aa, Homo sapiens
  Payload ID: 2981
  Gene Symbol: CHM
  Gene Name: choroideremia (Rab escort protein 1)
  Uniprot ID: P24386
  ENSP ID: ENSP00000484306
MADTLPSEFDVIVIGTGLPESIIAAACSRSGRRVLHVDSRSYYGGNWASFSFSGLLSWLKEYQENSDIVSDSPVWQDQILENEEAIALSRKDKTIQHVEVFCYARSTLLL

SEQ ID NO: 15178 - protein, 656 aa, Homo sapiens
  Payload ID: 2982
  Gene Symbol: CHML
  Gene Name: choroideremia-like (Rab escort protein 2)
  Uniprot ID: P26374
  ENSP ID: ENSP00000355511
MADNLPTEFDVVIIGTGLPESILAAACSRSGQRVLHIDSRSYYGGNWASFSFSGLLSWLKEYQQNNDIGEESTVVWQDLIHETEEAITLRKKDETIQHTEAFCYASQDMEDNVEEIGALQKNPSLGVSNTFTEVLDSALPEESQLSYFNSDEMPAKHTQKSDTEISLEVTDVEESVEKEKYCGDKTCMHTVSDKDGDKDESKSTVEDKADEPIRNRITYSQIVKEGRRFNIDLVSKLLYSQGLLIDLLIKSDVSRYVEFKNVTRILAFREGKVEQVPCSRADVFNSKELTMVEKRMLMKFLTFCLEYEQHPDEYQAFRQCSFSEYLKTKKLTPNLQHFVLHSIAMTSESSCTTIDGLNATKNFLQCLGRFGNTPFLFPLYGQGEIPQGFCRMCAVFGGIYCLRHKVQCFVVDKESGRCKAIIDHFGQRINAKYFIVEDSYLSEETCSNVQYKQISRAVLITDQSILKTDLDQQTSILIVPPAEPGACAVRVTELCSSTMTCMKDTYLVHLTCSSSKTAREDLESVVKKLFTPYTETEINEEELTKPRLLWALYFNMRDSSGISRSSYNGLPSNVYVCSGPDCGLGNEHAVKQAETLFQEIFPTEEFCPPPPNPEDIIFDGDDKQPEAPGTNNVVMAKLESSEESKNLESPEKHLQN

SEQ ID NO: 15179 - protein, 412 aa, Homo sapiens
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  Uniprot ID: Q494W8
  ENSP ID: ENSP00000299847
MQKYCIYQHFQFQLLIQHLWIAANCDIADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 15180 - protein, 321 aa, Homo sapiens
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  ENSP ID: ENSP00000380927
MQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 15181 - protein, 321 aa, Homo sapiens; identical to SEQ ID NO: 15180
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  ENSP ID: ENSP00000385389

SEQ ID NO: 15182 - protein, 104 aa, Homo sapiens
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  ENSP ID: ENSP00000455401
MQKYCIYQHFQFQLLIQHLWIAANCDIADERFDATFHTNVLVNSSGHCQYLPPGIFKSSCYIDVRWFPFDVQHCKLKFGSWSYGGWSLDLQMQEADISGYIPNG

SEQ ID NO: 15183 - protein, 412 aa, Homo sapiens
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  ENSP ID: ENSP00000478921
MQKYCIYQHFQFQLLIQHLWIAANCDIADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMLAPNFVEAVSKDFA

SEQ ID NO: 15184 - protein, 321 aa, Homo sapiens
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  ENSP ID: ENSP00000480968
MQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMLAPNFVEAVSKDFA

SEQ ID NO: 15185 - protein, 321 aa, Homo sapiens; identical to SEQ ID NO: 15184
  Payload ID: 2983
  Gene Symbol: CHRFAM7A
  Gene Name: CHRNA7 (cholinergic receptor, nicotinic, alpha 7, exons 5-10) and FAM7A (family with sequence similarity 7A, exons A-E) fusion
  ENSP ID: ENSP00000482305

SEQ ID NO: 15186 - protein, 131 aa, Homo sapiens
  Payload ID: 2984
  Gene Symbol: CHRAC1
  Gene Name: chromatin accessibility complex 1
  Uniprot ID: Q9NRG0
  ENSP ID: ENSP00000220913
MADVVVGKDKGGEQRLISLPLSRIRVIMKSSPEVSSINQEALVLTAKATELFVQCLATYSYRHGSGKEKKVLTYSDLANTAQQSETFQFLADILPKKILASKYLKMLKEEKREEDEENDNDNESDHDEADS

SEQ ID NO: 15187 - protein, 56 aa, Homo sapiens
  Payload ID: 2984
  Gene Symbol: CHRAC1
  Gene Name: chromatin accessibility complex 1
  ENSP ID: ENSP00000428697
MADVVVGKDKGGEQRLISLPLSRIRVIMKSSPEVSSINQEALVLTAKATIYYQRRF

SEQ ID NO: 15188 - protein, 97 aa, Homo sapiens
  Payload ID: 2984
  Gene Symbol: CHRAC1
  Gene Name: chromatin accessibility complex 1
  ENSP ID: ENSP00000430003
  MOD_RES (1)..(1): Any amino acid
XCPPAVSLALPFGKPELFVQCLATYSYRHGSGKEKKVLTYSDLANTAQQSETFQFLADILPKKILASKYLKMLKEEKREEDEENDNDNESDHDEADS

SEQ ID NO: 15189 - protein, 80 aa, Homo sapiens
  Payload ID: 2984
  Gene Symbol: CHRAC1
  Gene Name: chromatin accessibility complex 1
  ENSP ID: ENSP00000430484
FVAFLRSARPFLPCAPSPRPPHCPPAVSLALPFGKPELFVQCLATYSYRHGSGKEKKVLTYSDLANTAQQSETFQFLAGT

SEQ ID NO: 15190 - protein, 956 aa, Homo sapiens
  Payload ID: 2985
  Gene Symbol: CHAF1A
  Gene Name: chromatin assembly  factor 1, subunit A (p150)
  Uniprot ID: Q13111
  ENSP ID: ENSP00000301280
MLEELECGAPGARGAATAMDCKDRPAFPVKKLIQARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDKLAFPGETLSDIPCKTEEEGVGCGGAGRRGDSQECSPRSCPELTSGPRMCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRITKKFVKGSTEKNKLRLQRDQERLGKQLKLRAEREEKEKLKEEAKRAKEEAKKKKEEEKELKEKERREKREKDEKEKAEKQRLKEERRKERQEALEAKLEEKRKKEEEKRLREEEKRIKAEKAEITRFFQKPKTPQAPKTLAGSCGKFAPFEIKEHMVLAPRRRTAFHPDLCSQLDQLLQQQSGEFSFLKDLKGRQPLRSGPTHVSTRNADIFNSDVVIVERGKGDGVPERRKFGRMKLLQFCENHRPAYWGTWNKKTALIRARDPWAQDTKLLDYEVDSDEEWEEEEPGESLSHSEGDDDDDMGEDEDEDDGFFVPHGYLSEDEGVTEECADPENHKVRQKLKAKEWDEFLAKGKRFRVLQPVKIGCVWAADRDCAGDDLKVLQQFAACFLETLPAQEEQTPKASKRERRDEQILAQLLPLLHGNVNGSKVIIREFQEHCRRGLLSNHTGSPRSPSTTYLHTPTPSEDAAIPSKSRLKRLISENSVYEKRPDFRMCWYVHPQVLQSFQQEHLPVPCQWSYVTSVPSAPKEDSGSVPSTGPSQGTPISLKRKSAGSMCITQFMKKRRHDGQIGAEDMDGFQADTEEEEEEEGDCMIVDVPDAAEVQAPCGAASGAGGGVGVDTGKATLTASPLGAS

SEQ ID NO: 15191 - protein, 151 aa, Homo sapiens
  Payload ID: 2985
  Gene Symbol: CHAF1A
  Gene Name: chromatin assembly  factor 1, subunit A (p150)
  ENSP ID: ENSP00000465142
MLEELECGAPGARGAATARLPFKRLNLVPKGKADDMSDDQGTSVQSKSPDLEASLDTLENNCHVGSDIDFRPKLVNGKGPLDNFLRNRIETSIGQSTVIIDLTEDSNEQPDSLVDHNKLNSEASPSREAINGQREDTGDQQGLLKAIQNDK

SEQ ID NO: 15192 - protein, 47 aa, Homo sapiens
  Payload ID: 2985
  Gene Symbol: CHAF1A
  Gene Name: chromatin assembly  factor 1, subunit A (p150)
  ENSP ID: ENSP00000466475
EDMDGFQADTEEEEEEEGDCMIVDVPDAAAMRSLFQSLSDSPSCHLL

SEQ ID NO: 15193 - protein, 17 aa, Homo sapiens
  Payload ID: 2985
  Gene Symbol: CHAF1A
  Gene Name: chromatin assembly  factor 1, subunit A (p150)
  ENSP ID: ENSP00000466888
KFVKGSTEKNKLRLQRG

SEQ ID NO: 15194 - protein, 291 aa, Homo sapiens
  Payload ID: 2985
  Gene Symbol: CHAF1A
  Gene Name: chromatin assembly  factor 1, subunit A (p150)
  ENSP ID: ENSP00000467296
MCPRKEQDSWSEAGGILFKGKVPMVVLQDILAVRPPQIKSLPATPQGKNMTPESEVLESFPEEDSVLSHSSLSSPSSTSSPEGPPAPPKQHSSTSPFPTSTPLRRDQERLGKQLKLRAEREEKEKLKEEAKRAKEEAKKKKEEEKELKEKERREKREKDEKEKAEKQRLKEERRKERQEALEAKLEEKRKKEEEKRLREEEKRIKAEKAEITRFFQKPKTPQAPKTLAGSCGKFAPFEIKEHMVLAPRRRTAFHPDLCSQLDQLLQQQSGEFSFLKDLKGRQPLRSGPTHV

SEQ ID NO: 15195 - protein, 559 aa, Homo sapiens
  Payload ID: 2986
  Gene Symbol: CHAF1B
  Gene Name: chromatin assembly  factor 1, subunit B (p60)
  Uniprot ID: Q13112
  ENSP ID: ENSP00000315700
MKVITCEIAWHNKEPVYSLDFQHGTAGRIHRLASAGVDTNVRIWKVEKGPDGKAIVEFLSNLARHTKAVNVVRFSPTGEILASGGDDAVILLWKVNDNKEPEQIAFQDEDEAQLNKENWTVVKTLRGHLEDVYDICWATDGNLMASASVDNTAIIWDVSKGQKISIFNEHKSYVQGVTWDPLGQYVATLSCDRVLRVYSIQKKRVAFNVSKMLSGIGAEGEARSYRMFHDDSMKSFFRRLSFTPDGSLLLTPAGCVESGENVMNTTYVFSRKNLKRPIAHLPCPGKATLAVRCCPVYFELRPVVETGVELMSLPYRLVFAVASEDSVLLYDTQQSFPFGYVSNIHYHTLSDISWSSDGAFLAISSTDGYCSFVTFEKDELGIPLKEKPVLNMRTPDTAKKTKSQTHRGSSPGPRPVEGTPASRTQDPSSPGTTPPQARQAPAPTVIRDPPSITPAVKSPLPGPSEEKTLQPSSQNTKAHPSRRVTLNTLQAWSKTTPRRINLTPLKTDTPPSSVPTSVISTPSTEEIQSETPGDAQGSPPELKRPRLDENKGGTESLDP

SEQ ID NO: 15196 - protein, 546 aa, Homo sapiens
  Payload ID: 2987
  Gene Symbol: CDT1
  Gene Name: chromatin licensing and DNA replication  factor 1
  Uniprot ID: Q9H211
  ENSP ID: ENSP00000301019
MEQRRVTDFFARRRPGPPRIAPPKLACRTPSPARPALRAPASATSGSRKRARPPAAPGRDQARPPARRRLRLSVDEVSSPSTPEAPDIPACPSPGQKIKKSTPAAGQPPHLTSAQDQDTISELASCLQRARELGARVRALKASAQDAGESCTPEAEGRPEEPCGEKAPAYQRFHALAQPGLPGLVLPYKYQVLAEMFRSMDTIVGMLHNRSETPTFAKVQRGVQDMMRRRFEECNVGQIKTVYPASYRFRQERSVPTFKDGTRRSDYQLTIEPLLEQEADGAAPQLTASRLLQRRQIFSQKLVEHVKEHHKAFLASLSPAMVVPEDQLTRWHPRFNVDEVPDIEPAALPQPPATEKLTTAQEVLARARNLISPRMEKALSQLALRSAAPSSPGSPRPALPATPPATPPAASPSALKGVSQDLLERIRAKEAQKQLAQMTRCPEQEQRLQRLERLPELARVLRSVFVSERKPALSMEVACARMVGSCCTIMSPGEMEKHLLLLSELLPDWLSLHRIRTDTYVKLDKAADLAHITARLAHQTRAEEGL

SEQ ID NO: 15197 - protein, 190 aa, Homo sapiens
  Payload ID: 2987
  Gene Symbol: CDT1
  Gene Name: chromatin licensing and DNA replication  factor 1
  ENSP ID: ENSP00000456926
  MOD_RES (1)..(1): Any amino acid
XASYRFRQERSVPTFKDGTRRSDYQLTIEPLLEQEADGAAPQLTASRLLQRRQIFSQKLVEHVKEHHKAFLASLSPAMVVPEDQLTRWHPRFNVDEVPDIEPAALPQPPATEKLTTAQEMEKALSQLALRSAAPSSPGSPRPALPATPPATPPAASPSALKGVSQDLLERIRAKEAQKQLAQMTRCPEQE

SEQ ID NO: 15198 - protein, 101 aa, Homo sapiens
  Payload ID: 2988
  Gene Symbol: CHTOP
  Gene Name: chromatin target of PRMT1
  ENSP ID: ENSP00000357675
MQQQQQLASARNRRLAQQMENRPSVQAALKLKQKSLKQRLGKSNIQARLGRPIGALARGAIGGRGLPIIQRGLPRGGLRGGRATRTLLRGGMSLRGQCCVP

SEQ ID NO: 15199 - protein, 223 aa, Homo sapiens
  Payload ID: 2988
  Gene Symbol: CHTOP
  Gene Name: chromatin target of PRMT1
  ENSP ID: ENSP00000357676
MLKNKQPTPVNIRASMQQQQQLASARNRRLAQQMENRPSVQAALKLKQSLKQRLGKSNIQARLGRPIGALARGAIGGRGLPIIQRGLPRGGLRGGRATRTLLRGGMSLRGQNLLRGGRAVAPRMGLRRGGVRGRGGPGRGGLGRGAMGRGGIGGRGRGMIGRGRGGFGGRGRGRGRGRGALARPVLTKEQLDNQLDAYMSKTKGHLDAELDAYMAQTDPETND

SEQ ID NO: 15200 - protein, 249 aa, Homo sapiens
  Payload ID: 2988
  Gene Symbol: CHTOP
  Gene Name: chromatin target of PRMT1
  Uniprot ID: Q9Y3Y2
  ENSP ID: ENSP00000357679
MAAQSAPKVVLKSTTKMSLNERFTNMLKNKQPTPVNIRASMQQQQQLASARNRRLAQQMENRPSVQAALKLKQKSLKQRLGKSNIQARLGRPIGALARGAIGGRGLPIIQRGLPRGGLRGGRATRTLLRGGMSLRGQNLLRGGRAVAPRMGLRRGGVRGRGGPGRGGLGRGAMGRGGIGGRGRGMIGRGRGGFGGRGRGRGRGRGALARPVLTKEQLDNQLDAYMSKTKGHLDAELDAYMAQTDPETND

SEQ ID NO: 15201 - protein, 248 aa, Homo sapiens
  Payload ID: 2988
  Gene Symbol: CHTOP
  Gene Name: chromatin target of PRMT1
  Uniprot ID: Q9Y3Y2
  ENSP ID: ENSP00000357683
MAAQSAPKVVLKSTTKMSLNERFTNMLKNKQPTPVNIRASMQQQQQLASARNRRLAQQMENRPSVQAALKLKQSLKQRLGKSNIQARLGRPIGALARGAIGGRGLPIIQRGLPRGGLRGGRATRTLLRGGMSLRGQNLLRGGRAVAPRMGLRRGGVRGRGGPGRGGLGRGAMGRGGIGGRGRGMIGRGRGGFGGRGRGRGRGRGALARPVLTKEQLDNQLDAYMSKTKGHLDAELDAYMAQTDPETND

SEQ ID NO: 15202 - protein, 202 aa, Homo sapiens
  Payload ID: 2988
  Gene Symbol: CHTOP
  Gene Name: chromatin target of PRMT1
  Uniprot ID: Q9Y3Y2
  ENSP ID: ENSP00000385228
MAAQSAPKVVLKSTTKMSLNERFTNMLKNKQPTPVNIRASMQQQQQLASARNRRLAQQMENRPSVQAALKLKQSLKQRLGKSNIQARLGRPIGALARGAIGGRGLPIIQRGLPRGGLRGGRATRTLLRGGMSLRGRGMIGRGRGGFGGRGRGRGRGRGALARPVLTKEQLDNQLDAYMSKTKGHLDAELDAYMAQTDPETND

SEQ ID NO: 15203 - protein, 76 aa, Homo sapiens
  Payload ID: 2988
  Gene Symbol: CHTOP
  Gene Name: chromatin target of PRMT1
  ENSP ID: ENSP00000484038
MAAQSAPKVVLKSTTKMSLNERFTNMLKNKQPTPVNIRASMQQQQQLASARNRRLAQQMENRPSVQAALKLKQVGV

SEQ ID NO: 15204 - protein, 185 aa, Homo sapiens
  Payload ID: 2989
  Gene Symbol: CBX1
  Gene Name: chromobox homolog 1
  Uniprot ID: P83916
  ENSP ID: ENSP00000225603
MGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESKPKKKKEESEKPRGFARGLEPERIIGATDSSGELMFLMKWKNSDEADLVPAKEANVKCPQVVISFYEERLTWHSYPSEDDDKKDDKN

SEQ ID NO: 15205 - protein, 185 aa, Homo sapiens; identical to SEQ ID NO: 15204
  Payload ID: 2989
  Gene Symbol: CBX1
  Gene Name: chromobox homolog 1
  Uniprot ID: P83916
  ENSP ID: ENSP00000377060

SEQ ID NO: 15206 - protein, 168 aa, Homo sapiens
  Payload ID: 2989
  Gene Symbol: CBX1
  Gene Name: chromobox homolog 1
  ENSP ID: ENSP00000385413
MGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESKPKKKKEEVRIESEKPRGFARGLEPERIIGATDSSGELMFLMKWKNSDEADLVPAKEANVKCPQVVISFY

SEQ ID NO: 15207 - protein, 110 aa, Homo sapiens
  Payload ID: 2989
  Gene Symbol: CBX1
  Gene Name: chromobox homolog 1
  ENSP ID: ENSP00000393179
MGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESKPKKKKEESEKP

SEQ ID NO: 15208 - protein, 173 aa, Homo sapiens
  Payload ID: 2989
  Gene Symbol: CBX1
  Gene Name: chromobox homolog 1
  ENSP ID: ENSP00000462242
MGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESKPKKKKEESEKPRGFARGLEPERIIGATDSSGELMFLMKWKNSDEADLVPAKEANVKCPQVVISFYEERLTWHSY

SEQ ID NO: 15209 - protein, 138 aa, Homo sapiens
  Payload ID: 2989
  Gene Symbol: CBX1
  Gene Name: chromobox homolog 1
  ENSP ID: ENSP00000465985
MGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESKPKKKKEESEKPRGFARGLEPERIIGATDSSGELMFLMKW

SEQ ID NO: 15210 - protein, 211 aa, Homo sapiens
  Payload ID: 2990
  Gene Symbol: CBX2
  Gene Name: chromobox homolog 2
  Uniprot ID: Q14781
  ENSP ID: ENSP00000269399
MEELSSVGEQVFAAECILSKRLRKGKLEYLVKWRGWSSKHNSWEPEENILDPRLLLAFQKKEHEKEVQNRKRGKRPRGRPRKLTAMSSCSRRSKLKVGGCAGYADPTSQHPLGVGGRQREGLGPSGRGWHFCQQSVPLLGKQEPPFFLSLSFCCQGPQPAESSSPPLPGASCFSLSCTPLCWVAGSNCCRQALFPPRGSLGDGKEQEACVQ

SEQ ID NO: 15211 - protein, 532 aa, Homo sapiens
  Payload ID: 2990
  Gene Symbol: CBX2
  Gene Name: chromobox homolog 2
  Uniprot ID: Q14781
  ENSP ID: ENSP00000308750
MEELSSVGEQVFAAECILSKRLRKGKLEYLVKWRGWSSKHNSWEPEENILDPRLLLAFQKKEHEKEVQNRKRGKRPRGRPRKLTAMSSCSRRSKLKEPDAPSKSKSSSSSSSSTSSSSSSDEEDDSDLDAKRGPRGRETHPVPQKKAQILVAKPELKDPIRKKRGRKPLPPEQKATRRPVSLAKVLKTARKDLGAPASKLPPPLSAPVAGLAALKAHAKEACGGPSAMATPENLASLMKGMASSPGRGGISWQSSIVHYMNRMTQSQAQAASRLALKAQATNKCGLGLDLKVRTQKGELGMSPPGSKIPKAPSGGAVEQKVGNTGGPPHTHGASRVPAGCPGPQPAPTQELSLQVLDLQSVKNGMPGVGLLARHATATKGVPATNPAPGKGTGSGLIGASGATMPTDTSKSEKLASRAVAPPTPASKRDCVKGSATPSGQESRTAPGEARKAATLPEMSAGEESSSSDSDPDSASPPSTGQNPSVSVQTSQDWKPTRSLIEHVFVTDVTANLITVTVKESPTSVGFFNLRHY

SEQ ID NO: 15212 - protein, 183 aa, Homo sapiens
  Payload ID: 2991
  Gene Symbol: CBX3
  Gene Name: chromobox homolog 3
  Uniprot ID: Q13185
  ENSP ID: ENSP00000336687
MASNKTTLQKMGKKQNGKSKKVEEAEPEEFVVEKVLDRRVVNGKVEYFLKWKGFTDADNTWEPEENLDCPELIEAFLNSQKAGKEKDGTKRKSLSDSESDDSKSKKKRDAADKPRGFARGLDPERIIGATDSSGELMFLMKWKDSDEADLVLAKEANMKCPQIVIAFYEERLTWHSCPEDEAQ

SEQ ID NO: 15213 - protein, 183 aa, Homo sapiens; identical to SEQ ID NO: 15212
  Payload ID: 2991
  Gene Symbol: CBX3
  Gene Name: chromobox homolog 3
  Uniprot ID: Q13185
  ENSP ID: ENSP00000379670

SEQ ID NO: 15214 - protein, 101 aa, Homo sapiens
  Payload ID: 2991
  Gene Symbol: CBX3
  Gene Name: chromobox homolog 3
  ENSP ID: ENSP00000387348
MASNKTTLQKMGKKQNGKSKKVEEAEPEEFVVEKVLDRRVVNGKVEYFLKWKGFTEKLAKKKMVQKENLYLTVNLMTANQRRKEMLLTNQEDLPEVLILKE

SEQ ID NO: 15215 - protein, 62 aa, Homo sapiens
  Payload ID: 2991
  Gene Symbol: CBX3
  Gene Name: chromobox homolog 3
  ENSP ID: ENSP00000408672
MASNKTTLQKMGKKQNGKSKKVEEAEPEEFVVEKVLDRRVVNGKVEYFLKWKGFTDADNTWE

SEQ ID NO: 15216 - protein, 107 aa, Homo sapiens
  Payload ID: 2991
  Gene Symbol: CBX3
  Gene Name: chromobox homolog 3
  ENSP ID: ENSP00000473748
QKMGKKQNGKSKKVEEAEPEEFVVEKVLDRRVVNGKVEYFLKWKGFTDADNTWEPEENLDCPELIEAFLNSQKAGKEKDGTKRKSLSDSESDDSKSKKKRDAMRKRD

SEQ ID NO: 15217 - protein, 560 aa, Homo sapiens
  Payload ID: 2992
  Gene Symbol: CBX4
  Gene Name: chromobox homolog 4
  Uniprot ID: O00257
  ENSP ID: ENSP00000269397
MELPAVGEHVFAVESIEKKRIRKGRVEYLVKWRGWSPKYNTWEPEENILDPRLLIAFQNRERQEQLMGYRKRGPKPKPLVVQVPTFARRSNVLTGLQDSSTDNRAKLDLGAQGKGQGHQYELNSKKHHQYQPHSKERAGKPPPPGKSGKYYYQLNSKKHHPYQPDPKMYDLQYQGGHKEAPSPTCPDLGAKSHPPDKWAQGAGAKGYLGAVKPLAGAAGAPGKGSEKGPPNGMMPAPKEAVTGNGIGGKMKIVKNKNKNGRIVIVMSKYMENGMQAVKIKSGEVAEGEARSPSHKKRAADERHPPADRTFKKAAGAEEKKVEAPPKRREEEVSGVSDPQPQDAGSRKLSPTKEAFGEQPLQLTTKPDLLAWDPARNTHPPSHHPHPHPHHHHHHHHHHHHAVGLNLSHVRKRCLSETHGEREPCKKRLTARSISTPTCLGGSPAAERPADLPPAAALPQPEVILLDSDLDEPIDLRCVKTRSEAGEPPSSLQVKPETPASAAVAVAAAAAPTTTAEKPPAEAQDEPAESLSEFKPFFGNIIITDVTANCLTVTFKEYVTV

SEQ ID NO: 15218 - protein, 60 aa, Homo sapiens
  Payload ID: 2992
  Gene Symbol: CBX4
  Gene Name: chromobox homolog 4
  ENSP ID: ENSP00000415348
MELPAVGEHVFAVESIEKKRIRKGRVEYLVKWRGWSPKYNTWEPEENILDPRLLIAFQNS

SEQ ID NO: 15219 - protein, 90 aa, Homo sapiens
  Payload ID: 2992
  Gene Symbol: CBX4
  Gene Name: chromobox homolog 4
  ENSP ID: ENSP00000461198
  MOD_RES (1)..(1): Any amino acid
XENILDPRLLIAFQNRERQEQLMGYRKRGPKPKPLVVQTSHLLPPMRQLRTWWGLGRSRNSRHAVGLSPPSSHPCTRSLRCLPLPVVPMS

SEQ ID NO: 15220 - protein, 191 aa, Homo sapiens
  Payload ID: 2993
  Gene Symbol: CBX5
  Gene Name: chromobox homolog 5
  Uniprot ID: P45973
  ENSP ID: ENSP00000209875
MGKKTKRTADSSSSEDEEEYVVEKVLDRRVVKGQVEYLLKWKGFSEEHNTWEPEKNLDCPELISEFMKKYKKMKEGENNKPREKSESNKRKSNFSNSADDIKSKKKREQSNDIARGFERGLEPEKIIGATDSCGDLMFLMKWKDTDEADLVLAKEANVKCPQIVIAFYEERLTWHAYPEDAENKEKETAKS

SEQ ID NO: 15221 - protein, 191 aa, Homo sapiens; identical to SEQ ID NO: 15220
  Payload ID: 2993
  Gene Symbol: CBX5
  Gene Name: chromobox homolog 5
  Uniprot ID: P45973
  ENSP ID: ENSP00000401009

SEQ ID NO: 15222 - protein, 191 aa, Homo sapiens; identical to SEQ ID NO: 15220
  Payload ID: 2993
  Gene Symbol: CBX5
  Gene Name: chromobox homolog 5
  Uniprot ID: P45973
  ENSP ID: ENSP00000449207

SEQ ID NO: 15223 - protein, 91 aa, Homo sapiens
  Payload ID: 2993
  Gene Symbol: CBX5
  Gene Name: chromobox homolog 5
  ENSP ID: ENSP00000450190
MGKKTKRTADSSSSEDEEEYVVEKVLDRRVVKGQVEYLLKWKGFSEEHNTWEPEKNLDCPELISEFMKKYKKMKEGENNKPREKSESNKRK

SEQ ID NO: 15224 - protein, 394 aa, Homo sapiens
  Payload ID: 2994
  Gene Symbol: CBX6
  Gene Name: chromobox homolog 6
  ENSP ID: ENSP00000216083
MELSAVGERVFAAESIIKRRIRKGRIEYLVKWKGWAIKYSTWEPEENILDSRLIAAFEQKERERELYGPKKRGPKPKTFLLKPSASASSPKLHSSAAVHRLKKDIRRCHRMSRRPLPRPDPQGGSPGLRPPISPFSETVRIINRKVKPREPKRNRIILNLKVIDKGAGGGGAGQGAGALARPKVPSRNRVIGKSKKFSESVLRTQIRHMKFGAFALYKPPPAPLVAPSPGKAEASAPGPGLLLAAPAAPYDARSSGSSGCPSPTPQSSDPDDTPPKLLPETVSPSAPSWREPEVLDLSLPPESAATSKRAPPEVTAAAGPAPPTAPEPAGASSEPEAGDWRPEMSPCSNVVVTDVTSNLLTVTIKEFCNPEDFEKVAAGVAGAAGGGGSIGASK

SEQ ID NO: 15225 - protein, 412 aa, Homo sapiens
  Payload ID: 2994
  Gene Symbol: CBX6
  Gene Name: chromobox homolog 6
  Uniprot ID: O95503
  ENSP ID: ENSP00000384490
MELSAVGERVFAAESIIKRRIRKGRIEYLVKWKGWAIKYSTWEPEENILDSRLIAAFEQKERERELYGPKKRGPKPKTFLLKARAQAEALRISDVHFSVKPSASASSPKLHSSAAVHRLKKDIRRCHRMSRRPLPRPDPQGGSPGLRPPISPFSETVRIINRKVKPREPKRNRIILNLKVIDKGAGGGGAGQGAGALARPKVPSRNRVIGKSKKFSESVLRTQIRHMKFGAFALYKPPPAPLVAPSPGKAEASAPGPGLLLAAPAAPYDARSSGSSGCPSPTPQSSDPDDTPPKLLPETVSPSAPSWREPEVLDLSLPPESAATSKRAPPEVTAAAGPAPPTAPEPAGASSEPEAGDWRPEMSPCSNVVVTDVTSNLLTVTIKEFCNPEDFEKVAAGVAGAAGGGGSIGASK

SEQ ID NO: 15226 - protein, 251 aa, Homo sapiens
  Payload ID: 2995
  Gene Symbol: CBX7
  Gene Name: chromobox homolog 7
  Uniprot ID: O95931
  ENSP ID: ENSP00000216133
MELSAIGEQVFAVESIRKKRVRKGKVEYLVKWKGWPPKYSTWEPEEHILDPRLVMAYEEKEERDRASGYRKRGPKPKRLLLQRLYSMDLRSSHKAKGKEKLCFSLTCPLGSGSPEGVVKAGAPELVDKGPLVPTLPFPLRKPRKAHKYLRLSRKKFPPRGPNLESHSHRRELFLQEPPAPDVLQAAGEWEPAAQPPEEEADADLAEGPPPWTPALPSSEVTVTDITANSITVTFREAQAAEGFFRDRSGKF

SEQ ID NO: 15227 - protein, 158 aa, Homo sapiens
  Payload ID: 2995
  Gene Symbol: CBX7
  Gene Name: chromobox homolog 7
  ENSP ID: ENSP00000384035
MELSAIGEQVFAVESIRKKRVRKGKVEYLVKWKGWPPKYSTWEPEEHILDPRLVMAYEEKEERDRASGYRKRGPKPKRLLLQEPPAPDVLQAAGEWEPAAQPPEEEADADLAEGPPPWTPALPSSEVTVTDITANSITVTFREAQAAEGFFRDRSGKF

SEQ ID NO: 15228 - protein, 121 aa, Homo sapiens
  Payload ID: 2995
  Gene Symbol: CBX7
  Gene Name: chromobox homolog 7
  ENSP ID: ENSP00000410896
MELSAIGEQVFAVESIRKKRVRKGKVEYLVKWKGWPPKEERDRASGYRKRGPKPKRLLLQRLYSMDLRSSHKAKGKEKLCFSLTCPLGSGSPEGVVKAGAPELVDKGPLVPTLPFPLRKPR

SEQ ID NO: 15229 - protein, 389 aa, Homo sapiens
  Payload ID: 2996
  Gene Symbol: CBX8
  Gene Name: chromobox homolog 8
  Uniprot ID: Q9HC52
  ENSP ID: ENSP00000269385
MELSAVGERVFAAEALLKRRIRKGRMEYLVKWKGWSQKYSTWEPEENILDARLLAAFEEREREMELYGPKKRGPKPKTFLLKAQAKAKAKTYEFRSDSARGIRIPYPGRSPQDLASTSRAREGLRNMGLSPPASSTSTSSTCRAEAPRDRDRDRDRDRERDRERERERERERERERERERGTSRVDDKPSSPGDSSKKRGPKPRKELPDPSQRPLGEPSAGLGEYLKGRKLDDTPSGAGKFPAGHSVIQLARRQDSDLVQCGVTSPSSAEATGKLAVDTFPARVIKHRAAFLEAKGQGALDPNGTRVRHGSGPPSSGGGLYRDMGAQGGRPSLIARIPVARILGDPEEESWSPSLTNLEKVVVTDVTSNFLTVTIKESNTDQGFFKEKR

SEQ ID NO: 15230 - protein, 242 aa, Homo sapiens
  Payload ID: 2996
  Gene Symbol: CBX8
  Gene Name: chromobox homolog 8
  ENSP ID: ENSP00000405058
MSAAHVGKSGGQEGRMEYLVKWKGWSQKYSTWEPEENILDARLLAAFEEREREMELYGPKKRGPKPKTFLLKAQAKAKAKTYEFRSDSARGIRIPYPGRSPQDLASTSRAREGLRNMGLSPPASSTSTSSTCRAEAPRDRDRDRDRDRERDRERERERERERERERERERGTSRVDDKPSSPGDSSKKRGPKPRKELPDPSQRPLGEPSAGLGEYLKGRKLDDTPSGAGKFPAGHSVIQLAR

SEQ ID NO: 15231 - protein, 175 aa, Homo sapiens
  Payload ID: 2996
  Gene Symbol: CBX8
  Gene Name: chromobox homolog 8
  ENSP ID: ENSP00000408753
MEYLVKWKGWSQKYSTWEPEENILDARLLAAFEEREREMELYGPKKRGPKPKTFLLKAQAKAKAKTYEFRSDSARGIRIPYPGRSPQDLASTSRAREGLRNMGLSPPASSTSTSSTCRAEAPRDRDRDRDRDRERDRERERERERERERERERERGTSRVDDKPSSPGDSSKKRG

SEQ ID NO: 15232 - protein, 1710 aa, Homo sapiens
  Payload ID: 2997
  Gene Symbol: CHD1
  Gene Name: chromodomain helicase DNA binding protein 1
  Uniprot ID: O14646
  ENSP ID: ENSP00000284049
MNGHSDEESVRNSSGESSQSDDDSGSASGSGSGSSSGSSSDGSSSQSGSSDSDSGSESGSQSESESDTSRENKVQAKPPKVDGAEFWKSSPSILAVQRSAILKKQQQQQQQQQHQASSNSGSEEDSSSSEDSDDSSSEVKRKKHKDEDWQMSGSGSPSQSGSDSESEEEREKSSCDETESDYEPKNKVKSRKPQNRSKSKNGKKILGQKKRQIDSSEEDDDEEDYDNDKRSSRRQATVNVSYKEDEEMKTDSDDLLEVCGEDVPQPEEEEFETIERFMDCRIGRKGATGATTTIYAVEADGDPNAGFEKNKEPGEIQYLIKWKGWSHIHNTWETEETLKQQNVRGMKKLDNYKKKDQETKRWLKNASPEDVEYYNCQQELTDDLHKQYQIVERIIAHSNQKSAAGYPDYYCKWQGLPYSECSWEDGALISKKFQACIDEYFSRNQSKTTPFKDCKVLKQRPRFVALKKQPSYIGGHEGLELRDYQLNGLNWLAHSWCKGNSCILADEMGLGKTIQTISFLNYLFHEHQLYGPFLLVVPLSTLTSWQREIQTWASQMNAVVYLGDINSRNMIRTHEWTHHQTKRLKFNILLTTYEILLKDKAFLGGLNWAFIGVDEAHRLKNDDSLLYKTLIDFKSNHRLLITGTPLQNSLKELWSLLHFIMPEKFSSWEDFEEEHGKGREYGYASLHKELEPFLLRRVKKDVEKSLPAKVEQILRMEMSALQKQYYKWILTRNYKALSKGSKGSTSGFLNIMMELKKCCNHCYLIKPPDNNEFYNKQEALQHLIRSSGKLILLDKLLIRLRERGNRVLIFSQMVRMLDILAEYLKYRQFPFQRLDGSIKGELRKQALDHFNAEGSEDFCFLLSTRAGGLGINLASADTVVIFDSDWNPQNDLQAQARAHRIGQKKQVNIYRLVTKGSVEEDILERAKKKMVLDHLVIQRMDTTGKTVLHTGSAPSSSTPFNKEELSAILKFGAEELFKEPEGEEQEPQEMDIDEILKRAETHENEPGPLTVGDELLSQFKVANFSNMDEDDIELEPERNSKNWEEIIPEDQRRRLEEEERQKELEEIYMLPRMRNCAKQISFNGSEGRRSRSRRYSGSDSDSISEGKRPKKRGRPRTIPRENIKGFSDAEIRRFIKSYKKFGGPLERLDAIARDAELVDKSETDLRRLGELVHNGCIKALKDSSSGTERTGGRLGKVKGPTFRISGVQVNAKLVISHEEELIPLHKSIPSDPEERKQYTIPCHTKAAHFDIDWGKEDDSNLLIGIYEYGYGSWEMIKMDPDLSLTHKILPDDPDKKPQAKQLQTRADYLIKLLSRDLAKKEALSGAGSSKRRKARAKKNKAMKSIKVKEEIKSDSSPLPSEKSDEDDDKLSESKSDGRERSKKSSVSDAPVHITASGEPVPISEESEELDQKTFSICKERMRPVKAALKQLDRPEKGLSEREQLEHTRQCLIKIGDHITECLKEYTNPEQIKQWRKNLWIFVSKFTEFDARKLHKLYKHAIKKRQESQQNSDQNSNLNPHVIRNPDVERLKENTNHDDSSRDSYSSDRHLTQYHDHHKDRHQGDSYKKSDSRKRPYSSFSNGKDHRDWDHYKQDSRYYSDREKHRKLDDHRSRDHRSNLEGSLKDRSHSDHRSHSDHRLHSDHRSSSEYTHHKSSRDYRYHSDWQMDHRASSSGPRSPLDQRSPYGSRSPFEHSVEHKSTPEHTWSSRKT

SEQ ID NO: 15233 - protein, 113 aa, Homo sapiens
  Payload ID: 2997
  Gene Symbol: CHD1
  Gene Name: chromodomain helicase DNA binding protein 1
  ENSP ID: ENSP00000422225
ESKSDGRERSKKSSVSDAPVHITASGEPVPISEESEELDQKTFSICKERMRPVKAALKQLDRPEKGLSEREQLEHTRQCLIKIGDHITECLKEYTNPEQIKQWRNKTVIKTAT

SEQ ID NO: 15234 - protein, 22 aa, Homo sapiens
  Payload ID: 2997
  Gene Symbol: CHD1
  Gene Name: chromodomain helicase DNA binding protein 1
  ENSP ID: ENSP00000422589
ISEESEELDQKTFSIKPVDFCI

SEQ ID NO: 15235 - protein, 272 aa, Homo sapiens
  Payload ID: 2997
  Gene Symbol: CHD1
  Gene Name: chromodomain helicase DNA binding protein 1
  ENSP ID: ENSP00000479403
  MOD_RES (1)..(1): Any amino acid
XPDKKPQAKQLQTRADYLIKLLSRDLAKKEALSGAGSSKRRKARAKKNKAMKSIKVKEEIKSDSSPLPSEKSDEDDDKDEISSVKHPNKKIKTERDSEEKPEPDVYIKKEPEEKREAKEKENKKELKREIKEKEDKKDIKEKDFKEKRENKVKEAIQKEKDIKEEKLSESKSDGRERSKKSSVSDAPVHITASGEPVPISEESEELDQKTFSICKERMRPVKAALKQLDRPEKGLSEREQLEHTRQCLIKIGDHITECLKEYTNPEQIKQWR

SEQ ID NO: 15236 - protein, 1710 aa, Homo sapiens; identical to SEQ ID NO: 15232
  Payload ID: 2997
  Gene Symbol: CHD1
  Gene Name: chromodomain helicase DNA binding protein 1
  Uniprot ID: O14646
  ENSP ID: ENSP00000483667

SEQ ID NO: 15237 - protein, 616 aa, Homo sapiens
  Payload ID: 2998
  Gene Symbol: CHD1L
  Gene Name: chromodomain helicase DNA binding protein 1-like
  ENSP ID: ENSP00000355100
MSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 15238 - protein, 897 aa, Homo sapiens
  Payload ID: 2998
  Gene Symbol: CHD1L
  Gene Name: chromodomain helicase DNA binding protein 1-like
  Uniprot ID: Q86WJ1
  ENSP ID: ENSP00000358262
MERAGATSRGGQAPGFLLRLHTEGRAEAARVQEQDLRQWGLTGIHLRSYQLEGVNWLAQRFHCQNGCILGDEMGLGKTCQTIALFIYLAGRLNDEGPFLILCPLSVLSNWKEEMQRFAPGLSCVTYAGDKEERACLQQDLKQESRFHVLLTTYEICLKDASFLKSFPWSVLVVDEAHRLKNQSSLLHKTLSEFSVVFSLLLTGTPIQNSLQELYSLLSFVEPDLFSKEEVGDFIQRYQDIEKESESASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 15239 - protein, 693 aa, Homo sapiens
  Payload ID: 2998
  Gene Symbol: CHD1L
  Gene Name: chromodomain helicase DNA binding protein 1-like
  Uniprot ID: Q86WJ1
  ENSP ID: ENSP00000358263
MERAGATSRGGQAPGFLLRLHTEGRAEAARVQEQDLRQWGLTASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 15240 - protein, 797 aa, Homo sapiens
  Payload ID: 2998
  Gene Symbol: CHD1L
  Gene Name: chromodomain helicase DNA binding protein 1-like
  ENSP ID: ENSP00000389031
MAVSWEMRWAWGRPARFAPGLSCVTYAGDKEERACLQQDLKQESRFHVLLTTYEICLKDASFLKSFPWSVLVVDEAHRLKNQSSLLHKTLSEFSVVFSLLLTGTPIQNSLQELYSLLSFVEPDLFSKEEVGDFIQRYQDIEKESESASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 15241 - protein, 377 aa, Homo sapiens
  Payload ID: 2998
  Gene Symbol: CHD1L
  Gene Name: chromodomain helicase DNA binding protein 1-like
  ENSP ID: ENSP00000477985
MERAGATSRGGQAPGFLLRLHTEGRAEAARVQEQDLRQWGLTGIHLRSYQLEGVNWLAQRFHCQNGCILGDEMGLGKTCQTIALFIYLAGRLNDEGPFLILCPLSVLSNWKEEMQRFAPGLSCVTYAGDKEERACLQQDLKQESRFHVLLTTYEICLKDASFLKSFPWSVLVVDEAHRLKNQSSLLHKTLSEFSVVFSLLLTGTPIQNSLQELYSLLSFVEPDLFSKEEVGDFIQRYQDIEKESESASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGWSWHELNSSRYCDFC

SEQ ID NO: 15242 - protein, 82 aa, Homo sapiens
  Payload ID: 2998
  Gene Symbol: CHD1L
  Gene Name: chromodomain helicase DNA binding protein 1-like
  ENSP ID: ENSP00000480553
MERAGATSRGGQAPGFLLRLHTEGRAEAARVQEQDLRQWGLTGIHLRSYQLEGVNWLAQRFHCQNGCILGDEMGLGKTCQED

SEQ ID NO: 15243 - protein, 56 aa, Homo sapiens
  Payload ID: 2998
  Gene Symbol: CHD1L
  Gene Name: chromodomain helicase DNA binding protein 1-like
  ENSP ID: ENSP00000482764
MERAGATSRGGQAPGFLLRLHTEGRAEAARVQEQDLRQWGLTDSLGVFLLWMKLTG

SEQ ID NO: 15244 - protein, 1828 aa, Homo sapiens
  Payload ID: 2999
  Gene Symbol: CHD2
  Gene Name: chromodomain helicase DNA binding protein 2
  Uniprot ID: O14647
  ENSP ID: ENSP00000377747
MMRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRHHHDSKRRRSDEFRPQNYHQQDFRRMSDHRPAMGYHGQGPSDHYRSFHTDKLGEYKQPLPPLHPAVSDPRSPPSQKSPHDSKSPLDHRSPLERSLEQKNNPDYNWNVRKT

SEQ ID NO: 15245 - protein, 501 aa, Homo sapiens
  Payload ID: 2999
  Gene Symbol: CHD2
  Gene Name: chromodomain helicase DNA binding protein 2
  Uniprot ID: O14647
  ENSP ID: ENSP00000406581
MMRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCK

SEQ ID NO: 15246 - protein, 35 aa, Homo sapiens
  Payload ID: 2999
  Gene Symbol: CHD2
  Gene Name: chromodomain helicase DNA binding protein 2
  ENSP ID: ENSP00000485681
GVEDDSRLLLGIYEHGYGNWELIKTDPELKLTDKL

SEQ ID NO: 15247 - protein, 57 aa, Homo sapiens
  Payload ID: 2999
  Gene Symbol: CHD2
  Gene Name: chromodomain helicase DNA binding protein 2
  ENSP ID: ENSP00000485890
MWEEYPDVYGVRRSNRSRQEPSRFNIKEEASSGSESGSPKRRGQRQLKKQEKWKQEP

SEQ ID NO: 15248 - protein, 34 aa, Homo sapiens
  Payload ID: 2999
  Gene Symbol: CHD2
  Gene Name: chromodomain helicase DNA binding protein 2
  ENSP ID: ENSP00000485982
  MOD_RES (1)..(1): Any amino acid
XSQEEEEQKKKDDVTGEASFACLPWPTDAWTPKR

SEQ ID NO: 15249 - protein, 77 aa, Homo sapiens
  Payload ID: 2999
  Gene Symbol: CHD2
  Gene Name: chromodomain helicase DNA binding protein 2
  ENSP ID: ENSP00000486007
  MOD_RES (1)..(1): Any amino acid
XVDPEEKKKYCLTCRVKAAHFDVEWGVEDDSRLLLGIYEHGYGNWELIKTDPELKLTDKLQGFPAPGRRKSTTAGML

SEQ ID NO: 15250 - protein, 113 aa, Homo sapiens
  Payload ID: 2999
  Gene Symbol: CHD2
  Gene Name: chromodomain helicase DNA binding protein 2
  ENSP ID: ENSP00000486391
PPEENERENGQEILLRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKM

SEQ ID NO: 15251 - protein, 121 aa, Homo sapiens
  Payload ID: 2999
  Gene Symbol: CHD2
  Gene Name: chromodomain helicase DNA binding protein 2
  ENSP ID: ENSP00000486417
  MOD_RES (1)..(1): Any amino acid
XIKWKGWSYIHSTWESEESLQQQKVKGLKKLENFKKKEDEIKQWLGKVSPEDVEYFNCQQELASELNKQYQIVERVIAHSRKPAPSNEPEYLCKWMGLPYSECSWEDEALIGKKFQNCIDS

SEQ ID NO: 15252 - protein, 514 aa, Homo sapiens
  Payload ID: 2999
  Gene Symbol: CHD2
  Gene Name: chromodomain helicase DNA binding protein 2
  ENSP ID: ENSP00000486487
MAHKQREDYLNLSPCVFTWYRTFSQLAFDGEKLSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCK

SEQ ID NO: 15253 - protein, 1739 aa, Homo sapiens
  Payload ID: 2999
  Gene Symbol: CHD2
  Gene Name: chromodomain helicase DNA binding protein 2
  Uniprot ID: O14647
  ENSP ID: ENSP00000486629
MMRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRYAKGCETPGANLCQELFLGRK

SEQ ID NO: 15254 - protein, 45 aa, Homo sapiens
  Payload ID: 2999
  Gene Symbol: CHD2
  Gene Name: chromodomain helicase DNA binding protein 2
  ENSP ID: ENSP00000486926
MMRNKDKSQEEDSSLHSNASRYELSTFFLFVFFFGGETSAYNCLP

SEQ ID NO: 15255 - protein, 71 aa, Homo sapiens
  Payload ID: 2999
  Gene Symbol: CHD2
  Gene Name: chromodomain helicase DNA binding protein 2
  ENSP ID: ENSP00000486931
  MOD_RES (1)..(1): Any amino acid
XTLGQTDFPAHSRKPAPSNEPEYLCKWMGLPYSECSWEDEALIGKKFQNCIDSFHSRNNSKTIPTRECKVW

SEQ ID NO: 15256 - protein, 31 aa, Homo sapiens
  Payload ID: 2999
  Gene Symbol: CHD2
  Gene Name: chromodomain helicase DNA binding protein 2
  ENSP ID: ENSP00000487299
MMRNKDKSQEEDSSLHSNASRVVWNALSSEA

SEQ ID NO: 15257 - protein, 425 aa, Homo sapiens
  Payload ID: 2999
  Gene Symbol: CHD2
  Gene Name: chromodomain helicase DNA binding protein 2
  ENSP ID: ENSP00000487577
MMRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKVW

SEQ ID NO: 15258 - protein, 2000 aa, Homo sapiens
  Payload ID: 3000
  Gene Symbol: CHD3
  Gene Name: chromodomain helicase DNA binding protein 3
  Uniprot ID: Q12873
  ENSP ID: ENSP00000332628
MKAADTVILWARSKNDQLRISFPPGLCWGDRMPDKDDIRLLPSALGVKKRKRGPKKQKENKPGKPRKRKKRDSEEEFGSERDEYREKSESGGSEYGTGPGRKRRRKHREKKEKKTKRRKKGEGDGGQKQVEQKSSATLLLTWGLEDVEHVFSEEDYHTLTNYKAFSQFMRPLIAKKNPKIPMSKMMTILGAKWREFSANNPFKGSAAAVAAAAAAAAAAVAEQVSAAVSSATPIAPSGPPALPPPPAADIQPPPIRRAKTKEGKGPGHKRRSKSPRVPDGRKKLRGKKMAPLKIKLGLLGGKRKKGGSYVFQSDEGPEPEAEESDLDSGSVHSASGRPDGPVRTKKLKRGRPGRKKKKVLGCPAVAGEEEVDGYETDHQDYCEVCQQGGEIILCDTCPRAYHLVCLDPELDRAPEGKWSCPHCEKEGVQWEAKEEEEEYEEEGEEEGEKEEEDDHMEYCRVCKDGGELLCCDACISSYHIHCLNPPLPDIPNGEWLCPRCTCPVLKGRVQKILHWRWGEPPVAVPAPQQADGNPDVPPPRPLQGRSEREFFVKWVGLSYWHCSWAKELQLEIFHLVMYRNYQRKNDMDEPPPLDYGSGEDDGKSDKRKVKDPHYAEMEEKYYRFGIKPEWMTVHRIINHSVDKKGNYHYLVKWRDLPYDQSTWEEDEMNIPEYEEHKQSYWRHRELIMGEDPAQPRKYKKKKKELQGDGPPSSPTNDPTVKYETQPRFITATGGTLHMYQLEGLNWLRFSWAQGTDTILADEMGLGKTIQTIVFLYSLYKEGHTKGPFLVSAPLSTIINWEREFQMWAPKFYVVTYTGDKDSRAIIRENEFSFEDNAIKGGKKAFKMKREAQVKFHVLLTSYELITIDQAALGSIRWACLVVDEAHRLKNNQSKFFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATESTPGERGEEKPLDGQEHRERPEGETGDLGKREDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 15259 - protein, 1966 aa, Homo sapiens
  Payload ID: 3000
  Gene Symbol: CHD3
  Gene Name: chromodomain helicase DNA binding protein 3
  Uniprot ID: Q12873
  ENSP ID: ENSP00000350907
MKAADTVILWARSKNDQLRISFPPGLCWGDRMPDKDDIRLLPSALGVKKRKRGPKKQKENKPGKPRKRKKRDSEEEFGSERDEYREKSESGGSEYGTGPGRKRRRKHREKKEKKTKRRKKGEGDGGQKQVEQKSSATLLLTWGLEDVEHVFSEEDYHTLTNYKAFSQFMRPLIAKKNPKIPMSKMMTILGAKWREFSANNPFKGSAAAVAAAAAAAAAAVAEQVSAAVSSATPIAPSGPPALPPPPAADIQPPPIRRAKTKEGKGPGHKRRSKSPRVPDGRKKLRGKKMAPLKIKLGLLGGKRKKGGSYVFQSDEGPEPEAEESDLDSGSVHSASGRPDGPVRTKKLKRGRPGRKKKKVLGCPAVAGEEEVDGYETDHQDYCEVCQQGGEIILCDTCPRAYHLVCLDPELDRAPEGKWSCPHCEKEGVQWEAKEEEEEYEEEGEEEGEKEEEDDHMEYCRVCKDGGELLCCDACISSYHIHCLNPPLPDIPNGEWLCPRCTCPVLKGRVQKILHWRWGEPPVAVPAPQQADGNPDVPPPRPLQGRSEREFFVKWVGLSYWHCSWAKELQLEIFHLVMYRNYQRKNDMDEPPPLDYGSGEDDGKSDKRKVKDPHYAEMEEKYYRFGIKPEWMTVHRIINHSVDKKGNYHYLVKWRDLPYDQSTWEEDEMNIPEYEEHKQSYWRHRELIMGEDPAQPRKYKKKKKELQGDGPPSSPTNDPTVKYETQPRFITATGGTLHMYQLEGLNWLRFSWAQGTDTILADEMGLGKTIQTIVFLYSLYKEGHTKGPFLVSAPLSTIINWEREFQMWAPKFYVVTYTGDKDSRAIIRENEFSFEDNAIKGGKKAFKMKREAQVKFHVLLTSYELITIDQAALGSIRWACLVVDEAHRLKNNQSKFFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSEDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 15260 - protein, 2059 aa, Homo sapiens
  Payload ID: 3000
  Gene Symbol: CHD3
  Gene Name: chromodomain helicase DNA binding protein 3
  Uniprot ID: Q12873
  ENSP ID: ENSP00000369716
MASPLRDEEEEEEEMVVSEEEEEEEEEGDEEEEEEVEAADEDDEEDDDEGVLGRGPGHDRGRDRHSPPGCHLFPPPPPPPPPLPPPPPPPPPDKDDIRLLPSALGVKKRKRGPKKQKENKPGKPRKRKKRDSEEEFGSERDEYREKSESGGSEYGTGPGRKRRRKHREKKEKKTKRRKKGEGDGGQKQVEQKSSATLLLTWGLEDVEHVFSEEDYHTLTNYKAFSQFMRPLIAKKNPKIPMSKMMTILGAKWREFSANNPFKGSAAAVAAAAAAAAAAVAEQVSAAVSSATPIAPSGPPALPPPPAADIQPPPIRRAKTKEGKGPGHKRRSKSPRVPDGRKKLRGKKMAPLKIKLGLLGGKRKKGGSYVFQSDEGPEPEAEESDLDSGSVHSASGRPDGPVRTKKLKRGRPGRKKKKVLGCPAVAGEEEVDGYETDHQDYCEVCQQGGEIILCDTCPRAYHLVCLDPELDRAPEGKWSCPHCEKEGVQWEAKEEEEEYEEEGEEEGEKEEEDDHMEYCRVCKDGGELLCCDACISSYHIHCLNPPLPDIPNGEWLCPRCTCPVLKGRVQKILHWRWGEPPVAVPAPQQADGNPDVPPPRPLQGRSEREFFVKWVGLSYWHCSWAKELQLEIFHLVMYRNYQRKNDMDEPPPLDYGSGEDDGKSDKRKVKDPHYAEMEEKYYRFGIKPEWMTVHRIINHSVDKKGNYHYLVKWRDLPYDQSTWEEDEMNIPEYEEHKQSYWRHRELIMGEDPAQPRKYKKKKKELQGDGPPSSPTNDPTVKYETQPRFITATGGTLHMYQLEGLNWLRFSWAQGTDTILADEMGLGKTIQTIVFLYSLYKEGHTKGPFLVSAPLSTIINWEREFQMWAPKFYVVTYTGDKDSRAIIRENEFSFEDNAIKGGKKAFKMKREAQVKFHVLLTSYELITIDQAALGSIRWACLVVDEAHRLKNNQSKFFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATESTPGERGEEKPLDGQEHRERPEGETGDLGKREDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 15261 - protein, 383 aa, Homo sapiens
  Payload ID: 3000
  Gene Symbol: CHD3
  Gene Name: chromodomain helicase DNA binding protein 3
  ENSP ID: ENSP00000395252
KRAEDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKGKGRGGPARGRAHNAASEPAGGVAERHEGGRDPPASHAVPNTPHRSPPSDVRAQHPQPAGQQGHGASPHTGLPAGSLRYTSGVRGGLQRRTRRGPGRRRRQLQPDACRVLHHSRHQRPSSACEEGEGNGGGIGVRRAGSEGAPSRGGDLYRRLTGSQACPSPRPRPRGRPPAQALGPAASPPPSPPLGPSLG

SEQ ID NO: 15262 - protein, 525 aa, Homo sapiens
  Payload ID: 3000
  Gene Symbol: CHD3
  Gene Name: chromodomain helicase DNA binding protein 3
  ENSP ID: ENSP00000405861
  MOD_RES (1)..(1): Any amino acid
XQKQVEQKSSATLLLTWGLEDVEHVFSEEDYHTLTNYKAFSQFMRPLIAKKNPKIPMSKMMTILGAKWREFSANNPFKGSAAAVAAAAAAAAAAVAEQVSAAVSSATPIAPSGPPALPPPPAADIQPPPIRRAKTKEGKGPGHKRRSKSPRVPDGRKKLRGKKMAPLKIKLGLLGGKRKKGGSSDEGPEPEAEESDLDSGSVHSASGRPDGPVRTKKLKRGRPGRKKKKVLGCPAVAGEEEVDGYETDHQDYCEVCQQGGEIILCDTCPRAYHLVCLDPELDRAPEGKWSCPHCEKEGVQWEAKEEEEEYEEEGEEEGEKEEEDDHMEYCRVCKDGGELLCCDACISSYHIHCLNPPLPDIPNGEWLCPRCTCPVLKGRVQKILHWRWGEPPVAVPAPQQADGNPDVPPPRPLQGRSEREFFVKWVGLSYWHCSWAKELQLEIFHLVMYRNYQRKNDMDEPPPLDYGSGEDDGKSDKRKVKDPHYAEMEEKYYRFGIKPEWMTVHRIINHSVDKKGNYHYLVKWR

SEQ ID NO: 15263 - protein, 277 aa, Homo sapiens
  Payload ID: 3000
  Gene Symbol: CHD3
  Gene Name: chromodomain helicase DNA binding protein 3
  ENSP ID: ENSP00000411959
FNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKGLPAGSLRYTSGVRGGLQRRTRRGPGRRRRQLQPDACRVLHHSRHQRPSSACEEGEGNGGGIGVRRAGSEGAPSRGGDLYRRLTGSQACPSPRPRPRGRPPAQALGPAASPPPSPPLGPSLG

SEQ ID NO: 15264 - protein, 110 aa, Homo sapiens
  Payload ID: 3000
  Gene Symbol: CHD3
  Gene Name: chromodomain helicase DNA binding protein 3
  ENSP ID: ENSP00000458861
  MOD_RES (1)..(1): Any amino acid
XSPRVPDGRKKLRGKKMAPLKIKLGLLGGKRKKGGSYVFQSDEGPEPEAEESDLDSGSVHSASGRPDGPVRTKKLKRGRPGRKKKKVAGEEEVDGYETDHQDYCEVCQQG

SEQ ID NO: 15265 - protein, 249 aa, Homo sapiens
  Payload ID: 3000
  Gene Symbol: CHD3
  Gene Name: chromodomain helicase DNA binding protein 3
  ENSP ID: ENSP00000459321
RELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKAGGVAERHEGGRDPPASHAVPNTPHRSPPSDVRAQHPQPAGQQGHGASPHTGLPAGSLRYTSGVRGG

SEQ ID NO: 15266 - protein, 63 aa, Homo sapiens
  Payload ID: 3000
  Gene Symbol: CHD3
  Gene Name: chromodomain helicase DNA binding protein 3
  ENSP ID: ENSP00000467547
SVIHYDNEAIARLLDRNQDATEDTDVQNMNEYLSSFKVAQYVVREEDKVRLDFREKRRHRQYW

SEQ ID NO: 15267 - protein, 1912 aa, Homo sapiens
  Payload ID: 3001
  Gene Symbol: CHD4
  Gene Name: chromodomain helicase DNA binding protein 4
  Uniprot ID: Q14839
  ENSP ID: ENSP00000349508
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 15268 - protein, 354 aa, Homo sapiens
  Payload ID: 3001
  Gene Symbol: CHD4
  Gene Name: chromodomain helicase DNA binding protein 4
  ENSP ID: ENSP00000437506
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKK

SEQ ID NO: 15269 - protein, 1937 aa, Homo sapiens
  Payload ID: 3001
  Gene Symbol: CHD4
  Gene Name: chromodomain helicase DNA binding protein 4
  ENSP ID: ENSP00000440392
MASGLGSPSPCSAGSEEEDMDALLNNSLPPPHPEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRGVCGRPRPPPMGRSTRAVGPAHLPSLPPDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 15270 - protein, 1905 aa, Homo sapiens
  Payload ID: 3001
  Gene Symbol: CHD4
  Gene Name: chromodomain helicase DNA binding protein 4
  ENSP ID: ENSP00000440542
MASGLGSPSPCSAGSEEEDMDALLNNSLPPPHPENEEDPEEDLSETETPKLKKKKKPKKPRDPKIPKSKRQKKELGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 15271 - protein, 125 aa, Homo sapiens
  Payload ID: 3001
  Gene Symbol: CHD4
  Gene Name: chromodomain helicase DNA binding protein 4
  ENSP ID: ENSP00000444614
MASGLGSPSPCSAGSEEEDMDALLNNSLPPPHPENEEDPEEDLSETETPKLKKKKKPKKPRDPKIPKSKRQKKELGDSSGEGPEFVEEEEEVALRSDSEGSDYTPGKKKKKKLGPKKEKKSKSKR

SEQ ID NO: 15272 - protein, 1954 aa, Homo sapiens
  Payload ID: 3002
  Gene Symbol: CHD5
  Gene Name: chromodomain helicase DNA binding protein 5
  Uniprot ID: Q8TDI0
  ENSP ID: ENSP00000262450
MRGPVGTEEELPRLFAEEMENEDEMSEEEDGGLEAFDDFFPVEPVSLPKKKKPKKLKENKCKGKRKKKEGSNDELSENEEDLEEKSESEGSDYSPNKKKKKKLKDKKEKKAKRKKKDEDEDDNDDGCLKEPKSSGQLMAEWGLDDVDYLFSEEDYHTLTNYKAFSQFLRPLIAKKNPKIPMSKMMTVLGAKWREFSANNPFKGSSAAAAAAAVAAAVETVTISPPLAVSPPQVPQPVPIRKAKTKEGKGPGVRKKIKGSKDGKKKGKGKKTAGLKFRFGGISNKRKKGSSSEEDEREESDFDSASIHSASVRSECSAALGKKSKRRRKKKRIDDGDGYETDHQDYCEVCQQGGEIILCDTCPRAYHLVCLDPELEKAPEGKWSCPHCEKEGIQWEPKDDDDEEEEGGCEEEEDDHMEFCRVCKDGGELLCCDACPSSYHLHCLNPPLPEIPNGEWLCPRCTCPPLKGKVQRILHWRWTEPPAPFMVGLPGPDVEPSLPPPKPLEGIPEREFFVKWAGLSYWHCSWVKELQLELYHTVMYRNYQRKNDMDEPPPFDYGSGDEDGKSEKRKNKDPLYAKMEERFYRYGIKPEWMMIHRILNHSFDKKGDVHYLIKWKDLPYDQCTWEIDDIDIPYYDNLKQAYWGHRELMLGEDTRLPKRLLKKGKKLRDDKQEKPPDTPIVDPTVKFDKQPWYIDSTGGTLHPYQLEGLNWLRFSWAQGTDTILADEMGLGKTVQTIVFLYSLYKEGHSKGPYLVSAPLSTIINWEREFEMWAPDFYVVTYTGDKESRSVIRENEFSFEDNAIRSGKKVFRMKKEVQIKFHVLLTSYELITIDQAILGSIEWACLVVDEAHRLKNNQSKFFRVLNSYKIDYKLLLTGTPLQNNLEELFHLLNFLTPERFNNLEGFLEEFADISKEDQIKKLHDLLGPHMLRRLKADVFKNMPAKTELIVRVELSQMQKKYYKFILTRNFEALNSKGGGNQVSLLNIMMDLKKCCNHPYLFPVAAVEAPVLPNGSYDGSSLVKSSGKLMLLQKMLKKLRDEGHRVLIFSQMTKMLDLLEDFLEYEGYKYERIDGGITGGLRQEAIDRFNAPGAQQFCFLLSTRAGGLGINLATADTVIIYDSDWNPHNDIQAFSRAHRIGQNKKVMIYRFVTRASVEERITQVAKRKMMLTHLVVRPGLGSKSGSMTKQELDDILKFGTEELFKDDVEGMMSQGQRPVTPIPDVQSSKGGNLAASAKKKHGSTPPGDNKDVEDSSVIHYDDAAISKLLDRNQDATDDTELQNMNEYLSSFKVAQYVVREEDGVEEVEREIIKQEENVDPDYWEKLLRHHYEQQQEDLARNLGKGKRIRKQVNYNDASQEDQEWQDELSDNQSEYSIGSEDEDEDFEERPEGQSGRRQSRRQLKSDRDKPLPPLLARVGGNIEVLGFNARQRKAFLNAIMRWGMPPQDAFNSHWLVRDLRGKSEKEFRAYVSLFMRHLCEPGADGAETFADGVPREGLSRQHVLTRIGVMSLVRKKVQEFEHVNGKYSTPDLIPEGPEGKKSGEVISSDPNTPVPASPAHLLPAPLGLPDKMEAQLGYMDEKDPGAQKPRQPLEVQALPAALDRVESEDKHESPASKERAREERPEETEKAPPSPEQLPREEVLPEKEKILDKLELSLIHSRGDSSELRPDDTKAEEKEPIETQQNGDKEEDDEGKKEDKKGKFKFMFNIADGGFTELHTLWQNEERAAVSSGKIYDIWHRRHDYWLLAGIVTHGYARWQDIQNDPRYMILNEPFKSEVHKGNYLEMKNKFLARRFKLLEQALVIEEQLRRAAYLNMTQDPNHPAMALNARLAEVECLAESHQHLSKESLAGNKPANAVLHKVLNQLEELLSDMKADVTRLPSMLSRIPPVAARLQMSERSILSRLTNRAGDPTIQQGAFGSSQMYSNNFGPNFRGPGPGGIVNYNQMPLGPYVTDI

SEQ ID NO: 15273 - protein, 110 aa, Homo sapiens
  Payload ID: 3002
  Gene Symbol: CHD5
  Gene Name: chromodomain helicase DNA binding protein 5
  ENSP ID: ENSP00000367238
MLDLLEDFLEYEGYKYERIDGGITGGLRQEAIDRFNAPGAQQFCFLLSTRAGGLGINLATADTVIIYDSDWNPHNDIQVCAAAAHHPPRGPLIPGLRPSAAPTASARTRR

SEQ ID NO: 15274 - protein, 1225 aa, Homo sapiens
  Payload ID: 3002
  Gene Symbol: CHD5
  Gene Name: chromodomain helicase DNA binding protein 5
  ENSP ID: ENSP00000433676
MRGPVGTEEELPRLFAEEMENEDEMSEEEDGGLEAFDDFFPVEPVSLPKKKKPKKLKENKCKGKRKKKEGSNDELSENEEDLEEKSESEGSDYSPNKKKKKKLKDKKEKKAKRKKKDEDEDDNDDGCLKEPKSSGQLMAEWGLDDVDYLFSEEDYHTLTNYKAFSQFLRPLIAKKNPKIPMSKMMTVLGAKWREFSANNPFKGSSAAAAAAAVAAAVETVTISPPLAVSPPQVPQPVPIRKAKTKEGKGPGVRKKIKGSKDGKKKGKGKKTAGLKFRFGGISNKRKKGSSSEEDEREESDFDSASIHSASVRSECSAALGKKSKRRRKKKRIDDGDGYETDHQDYCEVCQQGGEIILCDTCPRAYHLVCLDPELEKAPEGKWSCPHCEKEGIQWEPKDDDDEEEEGGCEEEEDDHMEFCRVCKDGGELLCCDACPSSYHLHCLNPPLPEIPNGEWLCPRCTCPPLKGKVQRILHWRWTEPPAPFMVGLPGPDVEPSLPPPKPLEGIPEREFFVKWAGLSYWHCSWVKELQLELYHTVMYRNYQRKNDMDEPPPFDYGSGDEDGKSEKRKNKDPLYAKMEERFYRYGIKPEWMMIHRILNHSFDKKGDVHYLIKWKDLPYDQCTWEIDDIDIPYYDNLKQAYWGHRELMLGEDTRLPKRLLKKGKKLRDDKQEKPPDTPIVDPTVKFDKQPWYIDSTGGTLHPYQLEGLNWLRFSWAQGTDTILADEMGLGKTVQTIVFLYSLYKEGHSKGPYLVSAPLSTIINWEREFEMWAPDFYVVTYTGDKESRSVIRENEFSFEDNAIRSGKKVFRMKKEVQIKFHVLLTSYELITIDQAILGSIEWACLVVDEAHRLKNNQSKFFRVLNSYKIDYKLLLTGTPLQNNLEELFHLLNFLTPERFNNLEGFLEEFADISKEDQIKKLHDLLGPHMLRRLKADVFKNMPAKTELIVRVELSQMQKKYYKFILTRNFEALNSKGGGNQVSLLNIMMDLKKCCNHPYLFPVAAVEAPVLPNGSYDGSSLVKSSGKLMLLQKMLKKLRDEGHRVLIFSQMTKMLDLLEDFLEYEGYKYERIDGGITGGLRQEAIDRFNAPGAQQFCFLLSTRAGGLGINLATADTVIIYDSDWNPHNDIQAFSRAHRIGQTKWKPSWATWMRKTPGHRSQGSPWKSRPFQPPWIEWRVRTSTRAQPARREPERSGQRRRRRPRPPRSSCRERRCFLRRRRSWTSWS

SEQ ID NO: 15275 - protein, 90 aa, Homo sapiens
  Payload ID: 3002
  Gene Symbol: CHD5
  Gene Name: chromodomain helicase DNA binding protein 5
  ENSP ID: ENSP00000466440
  MOD_RES (1)..(1): Any amino acid
XQLEELLSDMKADVTRLPSMLSRIPPVAARLQMSERSILSRLTNRAGDPTIQQISSRPRDFPVLQRSFPAEPRLPGHLPDPHGREKLPPF

SEQ ID NO: 15276 - protein, 1060 aa, Homo sapiens
  Payload ID: 3002
  Gene Symbol: CHD5
  Gene Name: chromodomain helicase DNA binding protein 5
  ENSP ID: ENSP00000466706
  MOD_RES (1)..(1): Any amino acid
XYDQCTWEIDDIDIPYYDNLKQAYWGHRELMLGEDTRLPKRLLKKGKKLRDDKQEKPPDTPIVDPTVKFDKQPWYIDSTGGTLHPYQLEGLNWLRFSWAQGTDTILADEMGLGKTVQTIVFLYSLYKEGHSKGPYLVSAPLSTIINWEREFEMWAPDFYVVTYTGDKESRSVIRENEFSFEDNAIRSGKKVFRMKKEVQIKFHVLLTSYELITIDQAILGSIEWACLVVDEAHRLKNNQSKFFRVLNSYKIDYKLLLTGTPLQNNLEELFHLLNFLTPERFNNLEGFLEEFADISKEDQIKKLHDLLGPHMLRRLKADVFKNMPAKTELIVRVELSQMQKKYYKFILTRNFEALNSKGGGNQVSLLNIMMDLKKCCNHPYLFPVAAVEAPVLPNGSYDGSSLVKSSGKLMLLQKMLKKLRDEGHRVLIFSQMTKMLDLLEDFLEYEGYKYERIDGGITGGLRQEAIDRFNAPGAQQFCFLLSTRAGGLGINLATADTVIIYDSDWNPHNDIQAFSRAHRIGQNKKVMIYRFVTRASVEERITQVAKRKMMLTHLVVRPGLGSKSGSMTKQELDDILKFGTEELFKDDVEGMMSQGQRPVTPIPDVQSSKGGNLAASAKKKHGSTPPGDNKDVEDSSVIHYDDAAISKLLDRNQDATDDTELQNMNEYLSSFKVAQYVVREEDGVEEVEREIIKQEENVDPDYWEKLLRHHYEQQQEDLARNLGKGKRIRKQVNYNDASQEDQEWQDELSDNQSEYSIGSEDEDEDFEERPEGQSGRRQSRRQLKSDRDKPLPPLLARVGGNIEVLGFNARQRKAFLNAIMRWGMPPQDAFNSHWLVRDLRGKSEKEFRAYVSLFMRHLCEPGADGAETFADGVPREGLSRQHVLTRIGVMSLVRKKVQEFEHVNGKYSTPDLIPEGPEGKKSGEVISSDPNTPVPASPAHLLPAPLGLPDKMEAQLGYMDEKDPGAQKPRQPLEVQALPAALDRVESEDKHESPASKERAREERPEETEKAPPSPEQLPRASCSVTQAGVQWRHLGSWEPLSPRLKRPSHLSFLNRGGAS

SEQ ID NO: 15277 - protein, 127 aa, Homo sapiens
  Payload ID: 3002
  Gene Symbol: CHD5
  Gene Name: chromodomain helicase DNA binding protein 5
  ENSP ID: ENSP00000468624
  MOD_RES (1)..(1): Any amino acid
XLAASAKKKHGSTPPGDNKDVEDSSVIHYDDAAISKLLDRNQDATDDTELQNMNEYLSSFKVAQYVVREEDGVLSPKSSLWVSPGGLSVSSSAPHPPCRPGGGGAGNHQAGGERGPRLLGEAAAAPL

SEQ ID NO: 15278 - protein, 488 aa, Homo sapiens
  Payload ID: 3003
  Gene Symbol: CHD6
  Gene Name: chromodomain helicase DNA binding protein 6
  ENSP ID: ENSP00000308684
MEELEKDPRIAQKIKRFRNKQAQMKHIFTEPDEDLFNPDYVEVDRILEVAHTKDAETGEEVTHYLVKWCSLPYEESTWELEEDVDPAKVKEFESLQVLPEIKHVERPASDSWQKLEKSREYKNSNQLREYQLEGMNWLLFNWYNRKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPELKKIHWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPARELDVPLPDIDYMEIPVDWWDAEADKSLLIGVFKHGYERYNAMRADPALCFLEKVGMPDEKSLSAEQGVTDGTSDIPERQHR

SEQ ID NO: 15279 - protein, 373 aa, Homo sapiens
  Payload ID: 3003
  Gene Symbol: CHD6
  Gene Name: chromodomain helicase DNA binding protein 6
  Uniprot ID: Q8TD26
  ENSP ID: ENSP00000362319
MCQSHMIGFCTSSVNEETETQGDQISCPNPTTLVFRTQISSLPSLQLSNLKVLNHSPMSDASVNFDYKSPSPFDCSTDQEEKIEDVASHCLPQKDLYTAEEEAATLFPRKMTSHNGMEDSGGGGTGVKKKRKKKEPGDQEGAAKGSKDREPKPKRKREPKEPKEPRKAKEPKKAKEHKEPKQKDGAKKARKPREASGTKEAKEKRSCTDSAARTKSRKASKEQGPTPVEKKKKGKRKSETTVESLELDQGLTNPSLRSPEESTESTDSQKRRSGRQVKRRKYNEDLDFKVVDDDGETIAVLGAGRTSALSASTLAWQAEEPPEDDANIIEKILASKTVQEVHPGEPPFDLELFYVKYRNLYVYLKYSLYLGFI

SEQ ID NO: 15280 - protein, 2715 aa, Homo sapiens
  Payload ID: 3003
  Gene Symbol: CHD6
  Gene Name: chromodomain helicase DNA binding protein 6
  Uniprot ID: Q8TD26
  ENSP ID: ENSP00000362330
MKMKIQKKEKQLSNLKVLNHSPMSDASVNFDYKSPSPFDCSTDQEEKIEDVASHCLPQKDLYTAEEEAATLFPRKMTSHNGMEDSGGGGTGVKKKRKKKEPGDQEGAAKGSKDREPKPKRKREPKEPKEPRKAKEPKKAKEHKEPKQKDGAKKARKPREASGTKEAKEKRSCTDSAARTKSRKASKEQGPTPVEKKKKGKRKSETTVESLELDQGLTNPSLRSPEESTESTDSQKRRSGRQVKRRKYNEDLDFKVVDDDGETIAVLGAGRTSALSASTLAWQAEEPPEDDANIIEKILASKTVQEVHPGEPPFDLELFYVKYRNFSYLHCKWATMEELEKDPRIAQKIKRFRNKQAQMKHIFTEPDEDLFNPDYVEVDRILEVAHTKDAETGEEVTHYLVKWCSLPYEESTWELEEDVDPAKVKEFESLQVLPEIKHVERPASDSWQKLEKSREYKNSNQLREYQLEGMNWLLFNWYNRKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPELKKIHWSCVIIDEAHRLKNRNCKLLEGLKLMALEHKVLLTGTPLQNSVEELFSLLNFLEPSQFPSETAFLEEFGDLKTEEQVKKLQSILKPMMLRRLKDDVEKNLAPKQETIIEVELTNIQKKYYRAILEKNFSFLTKGANQHNMPNLINTMMELRKCCNHPYLINGAEEKILEDFRKTHSPDAPDFQLQAMIQAAGKLVLIDKLLPKLIAGGHKVLIFSQMVRCLDILEDYLIQRRYTYERIDGRVRGNLRQAAIDRFCKPDSDRFVFLLCTRAGGLGINLTAADTCIIFDSDWNPQNDLQAQARCHRIGQSKAVKVYRLITRNSYEREMFDKASLKLGLDKAVLQDINRKGGTNGVQQLSKMEVEDLLRKGAYGALMDEEDEGSKFCEEDIDQILQRRTHTITIQSEGKGSTFAKASFVASGNRTDISLDDPNFWQKWAKIAELDTEAKNEKESLVIDRPRVRKQTKHYNSFEEDELMEFSELDSDSDERPTRSRRLNDKARRYLRAECFRVEKNLLIFGWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPARELDVPLPDIDYMEIPVDWWDAEADKSLLIGVFKHGYERYNAMRADPALCFLEKVGMPDEKSLSAEQGVTDGTSDIPERGNTDKEDNAEDKVDGLQKQTESSSDGGDGVFSEKKDDSRAAQDGSDPDKSPWPVSSALTARLRRLVTVYQRCNRKELCRPEILGPGNQGYWVQEEMFRRTSEMDLINKEAQKRWTRREQADFYRTVSSFGVVYDQEKKTFDWTQFRIISRLDKKSDESLEQYFYSFVAMCRNVCRLPTWKDGGPPDTTIYVEPITEERAARTLYRIELLRKVREQVLKCPQLHERLQLCRPSLYLPVWWECGKHDRDLLIGTAKHGLNRTDCYIMNDPQLSFLDAYRNYAQHKRSGTQAPGNLCCLYQTNSKLYESLTYSQMSRTSESLENEPENLVRVESRDDHLSLPDVTCENFISKVQDVISINHDESLLPESLESMMYGKKVLSQEPSSFQESPSTNTESRKDVITISISKDGNCQSGGPEAEIASGPTFMGSLEAGGVAQANIKNGKHLLMSISKEGELCCSEAGQRPENIGQLEAKCLASPSLNPGNESGFVDMCSLSVCDSKRNLSSDQQLIDLLENKSLESKLILSQNHSDEEEEEEENEEENLAMAVGMGERPEVLHLTEPTTNISREKNQGFQDETKKGSLEVANQTPGLQRAFPAPAACQCHCKHMERWMHGLENDEFEIEKPKAYIPDLFKSKTNTIAMEGEPTAIPSQPFKVKHELLKEPWKESAEGQNVFPTYPLEGSELKSEDMDFENKDDYDRDGNCHSQDYPGKYSEEESKSSTSGITGDIGDELQEARAPTIAQLLQEKTLYSFSEWPKDRVIINRLDNICHVVLKGKWPSSQQYEPSGTLPTPVLTSSAGSRTSLSEPEAAEHSFSNGAALAAQIHKESFLAPVFTKDEQKHRRPYEFEVERDAKARGLEQFSATHGHTPIILNGWHGESAMDLSCSSEGSPGATSPFPVSASTPKIGAISSLQGALGMDLSGILQAGLIHPVTGQIVNGSLRRDDAATRRRRGRRKHVEGGMDLIFLKEQTLQAGILEVHEDPGQATLSTTHPEGPGPATSAPEPATAASSQAEKSIPSKSLLDWLRQQADYSLEVPGFGANFSDKPKQRRPRCKEPGKLDVSSLSGEERVPAIPKEPGLRGFLPENKFNHTLAEPILRDTGPRRRGRRPRSELLKAPSIVADSPSGMGPLFMNGLIAGMDLVGLQNMRNMPGIPLTGLVGFPAGFATMPTGEEVKSTLSMLPMMLPGMAAVPQMFGVGGLLSPPMATTCTSTAPASLSSTTKSGTAVTEKTAEDKPSSHDVKTDTLAEDKPGPGPFSDQSEPAITTSSPVAFNPFLIPGVSPGLIYPSMFLSPGMGMALPAMQQARHSEIVGLESQKRKKKKTKGDNPNSHPEPAPSCEREPSGDENCAEPSAPLPAEREHGAQAGEGALKDSNNDTN

SEQ ID NO: 15281 - protein, 149 aa, Homo sapiens
  Payload ID: 3003
  Gene Symbol: CHD6
  Gene Name: chromodomain helicase DNA binding protein 6
  ENSP ID: ENSP00000392503
MKMKIQKKEKQLSNLKVLNHSPMSDASVNFDYKSPSPFDCSTDQEEKIEDVASHCLPQKDLYTAEEEAATLFPRKMTSHNGMEDSGGGGTGVKKKRKKKEPGDQEGAAKGSKDREPKPKRKREPKEPKEPRKAKEPKKAKEHKEPKQKD

SEQ ID NO: 15282 - protein, 525 aa, Homo sapiens
  Payload ID: 3003
  Gene Symbol: CHD6
  Gene Name: chromodomain helicase DNA binding protein 6
  ENSP ID: ENSP00000404637
  MOD_RES (1)..(1): Any amino acid
XASKTVQEVHPGEPPFDLELFYVKYRNFSYLHCKWATMEELEKDPRIAQKIKRFRNKQAQMKHIFTEPDEDLFNPDYVEVDRILEVAHTKDAETGEEVTHYLVKWCSLPYEESTWELEEDVDPAKVKEFESLQVLPEIKHVERPASDSWQKLEKSREYKNSNQLREYQLEGMNWLLFNWYNRKNCILADEMGLGKTIQSITFLSEIFLRGIHGPFLIIAPLSTITNWEREFRTWTEMNAIVYHGSQISRQMIQQYEMVYRDAQGNPLSGVFKFHVVITTFEMILADCPELKKIHWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPARELDVPLPDIDYMEIPVDWWDAEADKSLLIGVFKHGYERYNAMRADPALCFLEKVGMPDEKSLSAEQGVTDGTSDIPERQHR

SEQ ID NO: 15283 - protein, 2997 aa, Homo sapiens
  Payload ID: 3004
  Gene Symbol: CHD7
  Gene Name: chromodomain helicase DNA binding protein 7
  Uniprot ID: Q9P2D1
  ENSP ID: ENSP00000392028
MADPGMMSLFGEDGNIFSEGLEGLGECGYPENPVNPMGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQVPDQIRAPYQQQQPQPQPPQPAPSGPPAQGHPQHMQQMGSYMARGDFSMQQHGQPQQRMSQFSQGQEGLNQGNPFIATSGPGHLSHVPQQSPSMAPSLRHSVQQFHHHPSTALHGESVAHSPRFSPNPPQQGAVRPQTLNFSSRSQTVPSPTINNSGQYSRYPYSNLNQGLVNNTGMNQNLGLTNNTPMNQSVPRYPNAVGFPSNSGQGLMHQQPIHPSGSLNQMNTQTMHPSQPQGTYASPPPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWAQLHPSPQNTPQKVPVHQHSPSEPFLEKPVPDMTQVSGPNAQLVKSDDYLPSIEQQPQQKKKKKKNNHIVAEDPSKGFGKDDFPGGVDNQELNRNSLDGSQEEKKKKKRSKAKKDPKEPKEPKEKKEPKEPKTPKAPKIPKEPKEKKAKTATPKPKSSKKSSNKKPDSEASALKKKVNKGKTEGSENSDLDKTPPPSPPPEEDEDPGVQKRRSSRQVKRKRYTEDLEFKISDEEADDADAAGRDSPSNTSQSEQQESVDAEGPVVEKIMSSRSVKKQKESGEEVEIEEFYVKYKNFSYLHCQWASIEDLEKDKRIQQKIKRFKAKQGQNKFLSEIEDELFNPDYVEVDRIMDFARSTDDRGEPVTHYLVKWCSLPYEDSTWERRQDIDQAKIEEFEKLMSREPETERVERPPADDWKKSESSREYKNNNKLREYQLEGVNWLLFNWYNMRNCILADEMGLGKTIQSITFLYEIYLKGIHGPFLVIAPLSTIPNWEREFRTWTELNVVVYHGSQASRRTIQLYEMYFKDPQGRVIKGSYKFHAIITTFEMILTDCPELRNIPWRCVVIDEAHRLKNRNCKLLEGLKMMDLEHKVLLTGTPLQNTVEELFSLLHFLEPSRFPSETTFMQEFGDLKTEEQVQKLQAILKPMMLRRLKEDVEKNLAPKEETIIEVELTNIQKKYYRAILEKNFTFLSKGGGQANVPNLLNTMMELRKCCNHPYLINGAEEKILEEFKETHNAESPDFQLQAMIQAAGKLVLIDKLLPKLKAGGHRVLIFSQMVRCLDILEDYLIQRRYPYERIDGRVRGNLRQAAIDRFSKPDSDRFVFLLCTRAGGLGINLTAADTCIIFDSDWNPQNDLQAQARCHRIGQSKSVKIYRLITRNSYEREMFDKASLKLGLDKAVLQSMSGRENATNGVQQLSKKEIEDLLRKGAYGALMDEEDEGSKFCEEDIDQILLRRTHTITIESEGKGSTFAKASFVASGNRTDISLDDPNFWQKWAKKAELDIDALNGRNNLVIDTPRVRKQTRLYSAVKEDELMEFSDLESDSEEKPCAKPRRPQDKSQGYARSECFRVEKNLLVYGWGRWTDILSHGRYKRQLTEQDVETICRTILVYCLNHYKGDENIKSFIWDLITPTADGQTRALVNHSGLSAPVPRGRKGKKVKAQSTQPVVQDADWLASCNPDALFQEDSYKKHLKHHCNKVLLRVRMLYYLRQEVIGDQADKILEGADSSEADVWIPEPFHAEVPADWWDKEADKSLLIGVFKHGYEKYNSMRADPALCFLERVGMPDAKAIAAEQRGTDMLADGGDGGEFDREDEDPEYKPTRTPFKDEIDEFANSPSEDKEESMEIHATGKHSESNAELGQLYWPNTSTLTTRLRRLITAYQRSYKRQQMRQEALMKTDRRRRRPREEVRALEAEREAIISEKRQKWTRREEADFYRVVSTFGVIFDPVKQQFDWNQFRAFARLDKKSDESLEKYFSCFVAMCRRVCRMPVKPDDEPPDLSSIIEPITEERASRTLYRIELLRKIREQVLHHPQLGERLKLCQPSLDLPEWWECGRHDRDLLVGAAKHGVSRTDYHILNDPELSFLDAHKNFAQNRGAGNTSSLNPLAVGFVQTPPVISSAHIQDERVLEQAEGKVEEPENPAAKEKCEGKEEEEETDGSGKESKQECEAEASSVKNELKGVEVGADTGSKSISEKGSEEDEEEKLEDDDKSEESSQPEAGAVSRGKNFDEESNASMSTARDETRDGFYMEDGDPSVAQLLHERTFAFSFWPKDRVMINRLDNICEAVLKGKWPVNRRQMFDFQGLIPGYTPTTVDSPLQKRSFAELSMVGQASISGSEDITTSPQLSKEDALNLSVPRQRRRRRRKIEIEAERAAKRRNLMEMVAQLRESQVVSENGQEKVVDLSKASREATSSTSNFSSLSSKFILPNVSTPVSDAFKTQMELLQAGLSRTPTRHLLNGSLVDGEPPMKRRRGRRKNVEGLDLLFMSHKRTSLSAEDAEVTKAFEEDIETPPTRNIPSPGQLDPDTRIPVINLEDGTRLVGEDAPKNKDLVEWLKLHPTYTVDMPSYVPKNADVLFSSFQKPKQKRHRCRNPNKLDINTLTGEERVPVVNKRNGKKMGGAMAPPMKDLPRWLEENPEFAVAPDWTDIVKQSGFVPESMFDRLLTGPVVRGEGASRRGRRPKSEIARAAAAAAAVASTSGINPLLVNSLFAGMDLTSLQNLQNLQSLQLAGLMGFPPGLATAATAGGDAKNPAAVLPLMLPGMAGLPNVFGLGGLLNNPLSAATGNTTTASSQGEPEDSTSKGEEKGNENEDENKDSEKSTDAVSAADSANGSVGAATAPAGLPSNPLAFNPFLLSTMAPGLFYPSMFLPPGLGGLTLPGFPALAGLQNAVGSSEEKAADKAEGGPFKDGETLEGSDAEESLDKTAESSLLEDEIAQGEELDSLDGGDEIENNENDE

SEQ ID NO: 15284 - protein, 19 aa, Homo sapiens
  Payload ID: 3004
  Gene Symbol: CHD7
  Gene Name: chromodomain helicase DNA binding protein 7
  ENSP ID: ENSP00000432627
  MOD_RES (1)..(1): Any amino acid
XSSMWGPRAVQACPRHQGN

SEQ ID NO: 15285 - protein, 39 aa, Homo sapiens
  Payload ID: 3004
  Gene Symbol: CHD7
  Gene Name: chromodomain helicase DNA binding protein 7
  ENSP ID: ENSP00000433336
HQPWAQLHPSPQNTPQKVPVHQHSPSEPFLEKPVPDMTQ

SEQ ID NO: 15286 - protein, 1138 aa, Homo sapiens
  Payload ID: 3004
  Gene Symbol: CHD7
  Gene Name: chromodomain helicase DNA binding protein 7
  Uniprot ID: Q9P2D1
  ENSP ID: ENSP00000436027
MADPGMMSLFGEDGNIFSEGLEGLGECGYPENPVNPMGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQVPDQIRAPYQQQQPQPQPPQPAPSGPPAQGHPQHMQQMGSYMARGDFSMQQHGQPQQRMSQFSQGQEGLNQGNPFIATSGPGHLSHVPQQSPSMAPSLRHSVQQFHHHPSTALHGESVAHSPRFSPNPPQQGAVRPQTLNFSSRSQTVPSPTINNSGQYSRYPYSNLNQGLVNNTGMNQNLGLTNNTPMNQSVPRYPNAVGFPSNSGQGLMHQQPIHPSGSLNQMNTQTMHPSQPQGTYASPPPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWAQLHPSPQNTPQKVPVHQHSPSEPFLEKPVPDMTQVSGPNAQLVKSDDYLPSIEQQPQQKKKKKKNNHIVAEDPSKGFGKDDFPGGVDNQELNRNSLDGSQEEKKKKKRSKAKKDPKEPKEPKEKKEPKEPKTPKAPKIPKEPKEKKAKTATPKPKSSKKSSNKKPDSEASALKKKVNKGKTEGSENSDLDKTPPPSPPPEEDEDPGVQKRRSSRQVKRKRYTEDLEFKISDEEADDADAAGRDSPSNTSQSEQQESVDAEGPVVEKIMSSRSVKKQKESGEEVEIEEFYVKYKNFSYLHCQWASIEDLEKDKRIQQKIKRFKAKQGQNKFLSEIEDELFNPDYVEVDRIMDFARSTDDRGEPVTHYLVKWCSLPYEDSTWERRQDIDQAKIEEFEKLMSREPETERVERPPADDWKKSESSREYKNNNKLREYQLEGVNWLLFNWYNMRNCILADEMGLGKTIQSITFLYEIYLKGIHGPFLVIAPLSTIPNWEREFRTWTELNVVVYHGSQASRRTIQLYEMYFKDPQGRVIKGSYKFHAIITTFEMILTDCPELRNIPWRCVVIDEAHRLKNRNCKLLEGLKMMDLVSDHIGDCTEPE

SEQ ID NO: 15287 - protein, 32 aa, Homo sapiens
  Payload ID: 3004
  Gene Symbol: CHD7
  Gene Name: chromodomain helicase DNA binding protein 7
  ENSP ID: ENSP00000436492
MADPGMMSLFGEDGNIFSEGLEGLGECGYPEN

SEQ ID NO: 15288 - protein, 948 aa, Homo sapiens
  Payload ID: 3004
  Gene Symbol: CHD7
  Gene Name: chromodomain helicase DNA binding protein 7
  Uniprot ID: Q9P2D1
  ENSP ID: ENSP00000437061
MADPGMMSLFGEDGNIFSEGLEGLGECGYPENPVNPMGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQVPDQIRAPYQQQQPQPQPPQPAPSGPPAQGHPQHMQQMGSYMARGDFSMQQHGQPQQRMSQFSQGQEGLNQGNPFIATSGPGHLSHVPQQSPSMAPSLRHSVQQFHHHPSTALHGESVAHSPRFSPNPPQQGAVRPQTLNFSSRSQTVPSPTINNSGQYSRYPYSNLNQGLVNNTGMNQNLGLTNNTPMNQSVPRYPNAVGFPSNSGQGLMHQQPIHPSGSLNQMNTQTMHPSQPQGTYASPPPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWAQLHPSPQNTPQKVPVHQHSPSEPFLEKPVPDMTQKPKQKRHRCRNPNKLDINTLTGEERVPVVNKRNGKKMGGAMAPPMKDLPRWLEENPEFAVAPDWTDIVKQSGFVPESMFDRLLTGPVVRGEGASRRGRRPKSEIARAAAAAAAVASTSGINPLLVNSLFAGMDLTSLQNLQNLQSLQLAGLMGFPPGLATAATAGGDAKNPAAVLPLMLPGMAGLPNVFGLGGLLNNPLSAATGNTTTASSQGEPEDSTSKGEEKGNENEDENKDSEKSTDAVSAADSANGSVGAATAPAGLPSNPLAFNPFLLSTMAPGLFYPSMFLPPGLGGLTLPGFPALAGLQNAVGSSEEKAADKAEGGPFKDGETLEGSDAEESLDKTAESSLLEDEIAQGEELDSLDGGDEIENNENDE

SEQ ID NO: 15289 - protein, 2581 aa, Homo sapiens
  Payload ID: 3005
  Gene Symbol: CHD8
  Gene Name: chromodomain helicase DNA binding protein 8
  Uniprot ID: Q9HCK8
  ENSP ID: ENSP00000382863
MADPIMDLFDDPNLFGLDSLTDDSFNQVTQDPIEEALGLPSSLDSLDQMNQDGGGGDVGNSSASELVPPPEETAPTELSKESTAPAPESITLHDYTTQPASQEQPAQPVLQTSTPTSGLLQVSKSQEILSQGNPFMGVSATAVSSSSAGGQPPQSAPKIVILKAPPSSSVTGAHVAQIQAQGITSTAQPLVAGTANGGKVTFTKVLTGTPLRPGVSIVSGNTVLAAKVPGNQAAVQRIVQPSRPVKQLVLQPVKGSAPAGNPGATGPPLKPAVTLTSTPTQGESKRITLVLQQPQSGGPQGHRHVVLGSLPGKIVLQGNQLAALTQAKNAQGQPAKVVTIQLQVQQPQQKIQIVPQPPSSQPQPQQPPSTQPVTLSSVQQAQIMGPGQSPGQRLSVPVKVVLQPQAGSSQGASSGLSVVKVLSASEVAALSSPASSAPHSGGKTGMEENRRLEHQKKQEKANRIVAEAIARARARGEQNIPRVLNEDELPSVRPEEEGEKKRRKKSAGERLKEEKPKKSKTSGASKTKGKSKLNTITPVVGKKRKRNTSSDNSDVEVMPAQSPREDEESSIQKRRSNRQVKRKKYTEDLDIKITDDEEEEEVDVTGPIKPEPILPEPVQEPDGETLPSMQFFVENPSEEDAAIVDKVLSMRIVKKELPSGQYTEAEEFFVKYKNYSYLHCEWATISQLEKDKRIHQKLKRFKTKMAQMRHFFHEDEEPFNPDYVEVDRILDESHSIDKDNGEPVIYYLVKWCSLPYEDSTWELKEDVDEGKIREFKRIQSRHPELKRVNRPQASAWKKLELSHEYKNRNQLREYQLEGVNWLLFNWYNRQNCILADEMGLGKTIQSIAFLQEVYNVGIHGPFLVIAPLSTITNWEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGFPNEDGEQMTPELLLLQERQRASEWPKDRVLINRIDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVELEVECMEEPNHLDVDLETRIPVINKVDGTLLVGEDAPRRAELEMWLQGHPEFAVDPRFLAYMEDRRKQKWQRCKKNNKAELNCLGMEPVQTANSRNGKKGHHTETVFNRVLPGPIAPESSKKRARRMRPDLSKMMALMQGGSTGSLSLHNTFQHSSSGLQSVSSLGHSSATSASLPFMPFVMGGAPSSPHVDSSTMLHHHHHHPHPHHHHHHHPGLRAPGYPSSPVTTASGTTLRLPPLQPEEDDDEDEEDDDDLSQGYDSSERDFSLIDDPMMPANSDSSEDADD

SEQ ID NO: 15290 - protein, 2302 aa, Homo sapiens
  Payload ID: 3005
  Gene Symbol: CHD8
  Gene Name: chromodomain helicase DNA binding protein 8
  Uniprot ID: Q9HCK8
  ENSP ID: ENSP00000406288
MKGESKRITLVLQQPQSGGPQGHRHVVLGSLPGKIVLQGNQLAALTQAKNAQGQPAKVVTIQLQVQQPQQKIQIVPQPPSSQPQPQQPPSTQPVTLSSVQQAQIMGPGQSPGQRLSVPVKVVLQPQAGSSQGASSGLSVVKVLSASEVAALSSPASSAPHSGGKTGMEENRRLEHQKKQEKANRIVAEAIARARARGEQNIPRVLNEDELPSVRPEEEGEKKRRKKSAGERLKEEKPKKSKTSGASKTKGKSKLNTITPVVGKKRKRNTSSDNSDVEVMPAQSPREDEESSIQKRRSNRQVKRKKYTEDLDIKITDDEEEEEVDVTGPIKPEPILPEPVQEPDGETLPSMQFFVENPSEEDAAIVDKVLSMRIVKKELPSGQYTEAEEFFVKYKNYSYLHCEWATISQLEKDKRIHQKLKRFKTKMAQMRHFFHEDEEPFNPDYVEVDRILDESHSIDKDNGEPVIYYLVKWCSLPYEDSTWELKEDVDEGKIREFKRIQSRHPELKRVNRPQASAWKKLELSHEYKNRNQLREYQLEGVNWLLFNWYNRQNCILADEMGLGKTIQSIAFLQEVYNVGIHGPFLVIAPLSTITNWEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGFPNEDGEQMTPELLLLQERQRASEWPKDRVLINRIDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVELEVECMEEPNHLDVDLETRIPVINKVDGTLLVGEDAPRRAELEMWLQGHPEFAVDPRFLAYMEDRRKQKWQRCKKNNKAELNCLGMEPVQTANSRNGKKGHHTETVFNRVLPGPIAPESSKKRARRMRPDLSKMMALMQGGSTGSLSLHNTFQHSSSGLQSVSSLGHSSATSASLPFMPFVMGGAPSSPHVDSSTMLHHHHHHPHPHHHHHHHPGLRAPGYPSSPVTTASGTTLRLPPLQPEEDDDEDEEDDDDLSQGYDSSERDFSLIDDPMMPANSDSSEDADD

SEQ ID NO: 15291 - protein, 98 aa, Homo sapiens
  Payload ID: 3005
  Gene Symbol: CHD8
  Gene Name: chromodomain helicase DNA binding protein 8
  ENSP ID: ENSP00000450860
MYLISILGSPVTRNLPPLLYGPYWHQPRQYEQGESKRITLVLQQPQSGGPQGHRHVVLGSLPGKIVLQGNQLAALTQAKNAQGQPAKVVTIQLQVQQP

SEQ ID NO: 15292 - protein, 151 aa, Homo sapiens
  Payload ID: 3005
  Gene Symbol: CHD8
  Gene Name: chromodomain helicase DNA binding protein 8
  ENSP ID: ENSP00000450957
MKVTQDPIEEALGLPSSLDSLDQMNQDGGGGDVGNSSASELVPPPEETAPTELSKESTAPAPESITLHDYTTQPASQEQPAQPVLQTSTPTSGLLQVSKSQEILSQGNPFMGVSATAVSSSSAGGQPPQSAPKIVILKAPPSSSVTGAHVA

SEQ ID NO: 15293 - protein, 226 aa, Homo sapiens
  Payload ID: 3005
  Gene Symbol: CHD8
  Gene Name: chromodomain helicase DNA binding protein 8
  ENSP ID: ENSP00000451071
IDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVEYMEDRRKQKWQRCKKNNKAELNCLGMEPVQTANSRNGKKGHHTETVFNRVLPGPIAPESSKKRARRMRPDLSKMMALMQGGSTGSLSLHNTFQH

SEQ ID NO: 15294 - protein, 873 aa, Homo sapiens
  Payload ID: 3005
  Gene Symbol: CHD8
  Gene Name: chromodomain helicase DNA binding protein 8
  ENSP ID: ENSP00000451442
  MOD_RES (1)..(1): Any amino acid
XKRIQSRHPELKRVNRPQASAWKKLELSHEYKNRNQLREYQLEGVNWLLFNWYNRQNCILADEMGLGKTIQSIAFLQEVYNVGIHGPFLVIAPLSTITNWEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSVFDVSPFPGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFK

SEQ ID NO: 15295 - protein, 2581 aa, Homo sapiens; identical to SEQ ID NO: 15289
  Payload ID: 3005
  Gene Symbol: CHD8
  Gene Name: chromodomain helicase DNA binding protein 8
  Uniprot ID: Q9HCK8
  ENSP ID: ENSP00000451601

SEQ ID NO: 15296 - protein, 2897 aa, Homo sapiens
  Payload ID: 3006
  Gene Symbol: CHD9
  Gene Name: chromodomain helicase DNA binding protein 9
  Uniprot ID: Q3L8U1
  ENSP ID: ENSP00000381522
MTDPMMDFFDDANLFGETLEGLSDDAFVQPGPVSLVDELNLGAEFEPLHIDSLNHVQGTPTHQKMTDFEQLNQFDSIKFHHVNQSFGSPAEHVLSPHSQFNCSPIHPQNQPNGLFPDVSDGSPMWGHQTATTISNQNGSPFHQQGHSHSMHQNKSFVAHHDFALFQANEQQTQCTSLRSQQNRNNLNPGQNSLSQSKNFMNVSGPHRVNVNHPPQMTNASNSQQSISMQQFSQTSNPSAHFHKCSSHQEGNFNGPSPNMTSCSVSNSQQFSSHYSFSSNHISPNSLLQSSAVLASNHTNQTLSDFTGSNSFSPHRGIKQESTQHILNPNTSLNSNNFQILHSSHPQGNYSNSKLSPVHMNFPDPVDSGTQMGHFNDHVETNGFSSLEENLLHQVESQTEPFTGLDPEDLLQEGLLPHFDESTFGQDNSSHILDHDLDRQFTSHLVTRPSDMAQTQLQSQARSWHSSFSNHQHLHDRNHLCLQRQPPSSKKSDGSGTYTKLQNTQVRVMSEKKQRKKVESESKQEKANRIISEAIAKAKERGERNIPRVMSPENFPTASVEGKEEKKGRRMKSKPKDKDSKKTKTCSKLKEKTKIGKLIITLGKKQKRKNESSDEISDAEQMPQHTLKDQDSQKRRSNRQIKRKKYAEDIEGKQSEEEVKGSMKIKKNSAPLPGEQPLQLFVENPSEEDAAIVDKILSSRTVKKEISPGVMIDTEEFFVKYKNYSYLHCEWATEEQLLKDKRIQQKIKRFKLRQAQRAHFFADMEEEPFNPDYVEVDRVLEVSFCEDKDTGEPVIYYLVKWCSLPYEDSTWELKEDVDLAKIEEFEQLQASRPDTRRLDRPPSNIWKKIDQSRDYKNGNQLREYQLEGLNWLLFNWYNRRNCILADEMGLGKTIQSITFLYEILLTGIRGPFLIIAPLSTIANWEREFRTWTDINVVVYHGSLISRQMIQQYEMYFRDSQGRIIRGAYRFQAIITTFEMILGGCGELNAIEWRCVIIDEAHRLKNKNCKLLEGLKLMNLEHKVLLTGTPLQNTVEELFSLLHFLEPLRFPSESTFMQEFGDLKTEEQVQKLQAILKPMMLRRLKEDVEKKLAPKEETIIEVELTNIQKKYYRAILEKNFSFLSKGAGQTNVPNLVNTMMELRKCCNHPYLIKGAEEKILGEFRDTYNPAASDFHLQAMIQSAGKLVLIDKLLPKMKAGGHKVLIFSQMVRCLDILEDYLIHKRYLYERIDGRVRGNLRQAAIDRFSKPDSDRFVFLLCTRAGGLGINLTAADTCIIFDSDWNPQNDLQAQARCHRIGQNKAVKVYRLVTRNSYEREMFDRASLKLGLDKAVLQSMSGRESNVGGIQQLSKKEIEDLLRRGAYGAIMEEEDEGSKFCEEDIDQILLRRTKTITIESEGRGSTFAKASFVASGNRTDISLDDPNFWQKWAKKAEIDIEAISGRNSLVIDTPRIRKQTRPFSATKDELAELSEAESEGDEKPKLRRPCDRSNGYGRTECFRVEKNLLVYGWGRWREILSHGRFKRQLNEHDVEIICRALLAYCLVHYRGDEKIKGFIWDLITPTEDGQTRELQNHLGLSAPVPRGRKGKKVKTQTSSFDIQKAEWLRKYNPEQLLQDEGYKKHIKHHCNKVLLRVRMLYYLKQEVIGNECQKVFDGVDASDIDVWVPEPDHSEVPAEWWDFDADKSLLIGVFKHGYEKYNTIRADPALCFLERVGKPDEKAVAAEQRANDYMDGDVEDPEYKPAPAIFKDDIEDDVSSPGDLVIADGDGQLMEGDKVYWPTQSALTTRLRRLITAYQRTNKNRQIQQIQPTFSVPTSVMQPIYEEATLNPKMAAKIERQQRWTRREEADFYRVVSTFGVVFDPDRGQFDWTKFRAMARLHKKTDDSLEKYLYAFMSMCRRVCRLPSKEELVDPNIFIQPITEERASRTLYRIELLRKVREQALRHPQLFERLKLCHPNPDLPVWWECGPHDRDLLIGAAKHGVSRTDYHILRDPELSFMAAQRNYSQSKMAHSRTSTPLLQQYQVALSASPLTSLPRLLDAKGIILEEMKVKSENLKEEPQSSEEESMSSVETRTLIKSEPVSPKNGVLPQATGDQKSGGKCETDRRMVAARTEPLTPNPASKKPRVHKRGSESSSDSDSDSERSSCSSRSSSSSSSSSCSHSRSGSSSSSSSSCSSASSSSSSSTSSSSSSSSSSSEESDSDEEEAQKRESTTHMKAYDEESVASLSTTQDETQDSFQMNNGTPESAYILQGGYMLAASYWPKDRVMINRLDSICQTVLKGKWPSARRSYDANTVASFYTTKLLDSPGAATEYSDPSVPTPPGAGVKEEHDQSTQMSKVKKHVREKEFTVKIKDEGGLKLTFQKQGLAQKRPFDGEDGALGQQQYLTRLRELQSASETSLVNFPKSIPVSGTSIQPTLGANGVILDNQPIVKKRRGRRKNVEGVDIFFFNRNKPPNHVSLGLTSSQISTGINPALSYTQPQGIPDTESPVPVINLKDGTRLAGDDAPKRKDLEKWLKEHPGYVEDLGAFIPRMQLHEGRPKQKRHRCRNPNKLDVNSLTGEERVQLINRRNARKVGGAFAPPLKDLCRFLKENSEYGVAPEWGDVVKQSGFLPESMYERILTGPVVREEVSRRGRRPKSGIAKATAAAAAASATSVSGNPLLANGLLPGVDLTTLQALQQNLQNLQSLQVTAGLMGMPTGLPSGGEAKNMAAMFPMLLSGMAGLPNLLGMGGLLTKPTESGTEDKKGSDSKESEGKTERTESQSSENGGENSVSSSPSTSSTAALNTAAAANPLALNPLLLSNILYPGMLLTPGLNLHIPTLSQSNTFDVQNKNSDLGSSKSVEVKEEDSRIKDQEDKGGTEPSPLNENSTDEGSEKADASSGSDSTSSSSEDSDSSNED

SEQ ID NO: 15297 - protein, 2897 aa, Homo sapiens; identical to SEQ ID NO: 15296
  Payload ID: 3006
  Gene Symbol: CHD9
  Gene Name: chromodomain helicase DNA binding protein 9
  Uniprot ID: Q3L8U1
  ENSP ID: ENSP00000396345

SEQ ID NO: 15298 - protein, 2881 aa, Homo sapiens
  Payload ID: 3006
  Gene Symbol: CHD9
  Gene Name: chromodomain helicase DNA binding protein 9
  Uniprot ID: Q3L8U1
  ENSP ID: ENSP00000455307
MTDPMMDFFDDANLFGETLEGLSDDAFVQPGPVSLVDELNLGAEFEPLHIDSLNHVQGTPTHQKMTDFEQLNQFDSIKFHHVNQSFGSPAEHVLSPHSQFNCSPIHPQNQPNGLFPDVSDGSPMWGHQTATTISNQNGSPFHQQGHSHSMHQNKSFVAHHDFALFQANEQQTQCTSLRSQQNRNNLNPGQNSLSQSKNFMNVSGPHRVNVNHPPQMTNASNSQQSISMQQFSQTSNPSAHFHKCSSHQEGNFNGPSPNMTSCSVSNSQQFSSHYSFSSNHISPNSLLQSSAVLASNHTNQTLSDFTGSNSFSPHRGIKQESTQHILNPNTSLNSNNFQILHSSHPQGNYSNSKLSPVHMNFPDPVDSGTQMGHFNDHVETNGFSSLEENLLHQVESQTEPFTGLDPEDLLQEGLLPHFDESTFGQDNSSHILDHDLDRQFTSHLVTRPSDMAQTQLQSQARSWHSSFSNHQHLHDRNHLCLQRQPPSSKKSDGSGTYTKLQNTQVRVMSEKKQRKKVESESKQEKANRIISEAIAKAKERGERNIPRVMSPENFPTASVEGKEEKKGRRMKSKPKDKDSKKTKTCSKLKEKTKIGKLIITLGKKQKRKNESSDEISDAEQMPQHTLKDQDSQKRRSNRQIKRKKYAEDIEGKQSEEEVKGSMKIKKNSAPLPGEQPLQLFVENPSEEDAAIVDKILSSRTVKKEISPGVMIDTEEFFVKYKNYSYLHCEWATEEQLLKDKRIQQKIKRFKLRQAQRAHFFADMEEEPFNPDYVEVDRVLEVSFCEDKDTGEPVIYYLVKWCSLPYEDSTWELKEDVDLAKIEEFEQLQASRPDTRRLDRPPSNIWKKIDQSRDYKNGNQLREYQLEGLNWLLFNWYNRRNCILADEMGLGKTIQSITFLYEILLTGIRGPFLIIAPLSTIANWEREFRTWTDINVVVYHGSLISRQMIQQYEMYFRDSQGRIIRGAYRFQAIITTFEMILGGCGELNAIEWRCVIIDEAHRLKNKNCKLLEGLKLMNLEHKVLLTGTPLQNTVEELFSLLHFLEPLRFPSESTFMQEFGDLKTEEQVQKLQAILKPMMLRRLKEDVEKKLAPKEETIIEVELTNIQKKYYRAILEKNFSFLSKGAGQTNVPNLVNTMMELRKCCNHPYLIKGAEEKILGEFRDTYNPAASDFHLQAMIQSAGKLVLIDKLLPKMKAGGHKVLIFSQMVRCLDILEDYLIHKRYLYERIDGRVRGNLRQAAIDRFSKPDSDRFVFLLCTRAGGLGINLTAADTCIIFDSDWNPQNDLQAQARCHRIGQNKAVKVYRLVTRNSYEREMFDRASLKLGLDKAVLQSMSGRESNVGGIQQLSKKEIEDLLRRGAYGAIMEEEDEGSKFCEEDIDQILLRRTKTITIESEGRGSTFAKASFVASGNRTDISLDDPNFWQKWAKKAEIDIEAISGRNSLVIDTPRIRKQTRPFSATKDELAELSEAESEGDEKPKLRRPCDRSNGYGRTECFRVEKNLLVYGWGRWREILSHGRFKRQLNEHDVEIICRALLAYCLVHYRGDEKIKGFIWDLITPTEDGQTRELQNHLGLSAPVPRGRKGKKVKTQTSSFDIQKAEWLRKYNPEQLLQDEGYKKHIKHHCNKVLLRVRMLYYLKQEVIGNECQKVFDGVDASDIDVWVPEPDHSEVPAEWWDFDADKSLLIGVFKHGYEKYNTIRADPALCFLERVGKPDEKAVAAEQRANDYMDGDVEDPEYKPAPAIFKDDIEDDVSSPGDLVIADGDGQLMEGDKVYWPTQSALTTRLRRLITAYQRTNKNRQIQQIQPTFSVPTSVMQPIYEEATLNPKMAAKIERQQRWTRREEADFYRVVSTFGVVFDPDRGQFDWTKFRAMARLHKKTDDSLEKYLYAFMSMCRRVCRLPSKEELVDPNIFIQPITEERASRTLYRIELLRKVREQALRHPQLFERLKLCHPNPDLPVWWECGPHDRDLLIGAAKHGVSRTDYHILRDPELSFMAAQRNYSQSKMAHSRTSTPLLQQYQVALSASPLTSLPRLLDAKGIILEEMKVKSENLKEEPQSSEEESMSSVETRTLIKSEPVSPKNGVLPQATGDQKSGGKCETDRRMVAARTEPLTPNPASKKPRVHKRGSESSSDSDSDSERSSCSSRSSSSSSSSSCSHSRSGSSSSSSSSCSSASSSSSSSTSSSSSSSSSSSEESDSDEEEAQKRESTTHMKAYDEESVASLSTTQDETQDSFQMNNGTPESAYILQGGYMLAASYWPKDRVMINRLDSICQTVLKGKWPSARRSYDANTVASFYTTKLLDSPGAATEYSDPSVPTPPGAGVKEEHDQSTQMSKEGGLKLTFQKQGLAQKRPFDGEDGALGQQQYLTRLRELQSASETSLVNFPKSIPVSGTSIQPTLGANGVILDNQPIVKKRRGRRKNVEGVDIFFFNRNKPPNHVSLGLTSSQISTGINPALSYTQPQGIPDTESPVPVINLKDGTRLAGDDAPKRKDLEKWLKEHPGYVEDLGAFIPRMQLHEGRPKQKRHRCRNPNKLDVNSLTGEERVQLINRRNARKVGGAFAPPLKDLCRFLKENSEYGVAPEWGDVVKQSGFLPESMYERILTGPVVREEVSRRGRRPKSGIAKATAAAAAASATSVSGNPLLANGLLPGVDLTTLQALQQNLQNLQSLQVTAGLMGMPTGLPSGGEAKNMAAMFPMLLSGMAGLPNLLGMGGLLTKPTESGTEDKKGSDSKESEGKTERTESQSSENGGENSVSSSPSTSSTAALNTAAAANPLALNPLLLSNILYPGMLLTPGLNLHIPTLSQSNTFDVQNKNSDLGSSKSVEVKEEDSRIKDQEDKGGTEPSPLNENSTDEGSEKADASSGSDSTSSSSEDSDSSNED

SEQ ID NO: 15299 - protein, 125 aa, Homo sapiens
  Payload ID: 3006
  Gene Symbol: CHD9
  Gene Name: chromodomain helicase DNA binding protein 9
  ENSP ID: ENSP00000456415
MSEKKQRKKVESESKQEKANRIISEAIAKAKERGERNIPRVMSPENFPTASVEGKEEKKGRRMKSKPKDKDSKKTKTCSKLKEKTKIGKLIITLGKKQKRKNESSDEISDAEQMPQHTLKDQDSQ

SEQ ID NO: 15300 - protein, 632 aa, Homo sapiens
  Payload ID: 3006
  Gene Symbol: CHD9
  Gene Name: chromodomain helicase DNA binding protein 9
  ENSP ID: ENSP00000456793
MTDPMMDFFDDANLFGETLEGLSDDAFVQPGPVSLVDELNLGAEFEPLHIDSLNHVQGTPTHQKMTDFEQLNQFDSIKFHHVNQSFGSPAEHVLSPHSQFNCSPIHPQNQPNGLFPDVSDGSPMWGHQTATTISNQNGSPFHQQGHSHSMHQNKSFVAHHDFALFQANEQQTQCTSLRSQQNRNNLNPGQNSLSQSKNFMNVSGPHRVNVNHPPQMTNASNSQQSISMQQFSQTSNPSAHFHKCSSHQEGNFNGPSPNMTSCSVSNSQQFSSHYSFSSNHISPNSLLQSSAVLASNHTNQTLSDFTGSNSFSPHRGIKQESTQHILNPNTSLNSNNFQILHSSHPQGNYSNSKLSPVHMNFPDPVDSGTQMGHFNDHVETNGFSSLEENLLHQVESQTEPFTGLDPEDLLQEGLLPHFDESTFGQDNSSHILDHDLDRQFTSHLVTRPSDMAQTQLQSQARSWHSSFSNHQHLHDRNHLCLQRQPPSSKKSDGSGTYTKLQNTQVRVMSEKKQRKKVESESKQEKANRIISEAIAKAKERGERNIPRVMSPENFPTASVEGKEEKKGRRMKSKPKDKDSKKTKTCSKLKEKTKIGKLIITLGKKQKRKNESSDEISDAEQMPQHTLKDQDSQ

SEQ ID NO: 15301 - protein, 1098 aa, Homo sapiens
  Payload ID: 3006
  Gene Symbol: CHD9
  Gene Name: chromodomain helicase DNA binding protein 9
  ENSP ID: ENSP00000457355
MSSVKRPRGRPPSSKKSDGSGTYTKLQNTQVRVMSEKKQRKKVESESKQEKANRIISEAIAKAKERGERNIPRVMSPENFPTASVEGKEEKKGRRMKSKPKDKDSKKTKTCSKLKEKTKIGKLIITLGKKQKRKNESSDEISDAEQMPQHTLKDQDSQKRRSNRQIKRKKYAEDIEGKQSEEEVKGSMKIKKNSAPLPGEQPLQLFVENPSEEDAAIVDKILSSRTVKKEISPGVMIDTEEFFVKYKNYSYLHCEWATEEQLLKDKRIQQKIKRFKLRQAQRAHFFADMEEEPFNPDYVEVDRVLEVSFCEDKDTGEPVIYYLVKWCSLPYEDSTWELKEDVDLAKIEEFEQLQASRPDTRRLDRPPSNIWKKIDQSRDYKNGNQLREYQLEGLNWLLFNWYNRRNCILADEMGLGKTIQSITFLYEILLTGIRGPFLIIAPLSTIANWEREFRTWTDINVVVYHGSLISRQMIQQYEMYFRDSQGRIIRGAYRFQAIITTFEMILGGCGELNAIEWRCVIIDEAHRLKNKNCKLLEGLKLMNLEHKVLLTGTPLQNTVEELFSLLHFLEPLRFPSESTFMQEFGDLKTEEQVQKLQAILKPMMLRRLKEDVEKKLAPKEETIIEVELTNIQKKYYRAILEKNFSFLSKGAGQTNVPNLVNTMMELRKCCNHPYLIKGAEEKILGEFRDTYNPAASDFHLQAMIQSAGKLVLIDKLLPKMKAGGHKVLIFSQMVRCLDILEDYLIHKRYLYERIDGRVRGNLRQAAIDRFSKPDSDRFVFLLCTRAGGLGINLTAADTCIIFDSDWNPQNDLQAQARCHRIGQNKAVKVYRLVTRNSYEREMFDRASLKLGLDKAVLQSMSGRESNVGGIQQLSKKEIEDLLRRGAYGAIMEEEDEGSKFCEEDIDQILLRRTKTITIESEGRGSTFAKASFVASGNRTDISLDDPNFWQKWAKKAEIDIEAISGRNSLVIDTPRIRKQTRPFSATKDELAELSEAESEGDEKPKLRRPCDRSNGYGRTECFRVEKNLLVYGWGRWREILSHGRFKRQLNEHDVEIICRALLAYCLVHYRGDEKIKGFIWDLITPTEDGQTRELQNHL

SEQ ID NO: 15302 - protein, 2881 aa, Homo sapiens; identical to SEQ ID NO: 15298
  Payload ID: 3006
  Gene Symbol: CHD9
  Gene Name: chromodomain helicase DNA binding protein 9
  Uniprot ID: Q3L8U1
  ENSP ID: ENSP00000457466

SEQ ID NO: 15303 - protein, 53 aa, Homo sapiens
  Payload ID: 3006
  Gene Symbol: CHD9
  Gene Name: chromodomain helicase DNA binding protein 9
  ENSP ID: ENSP00000457929
MTDPMMDFFDDANLFGETLEGLSDDAFVQPGPVSLVDELNLGAEFEPLHIDSL

SEQ ID NO: 15304 - protein, 91 aa, Homo sapiens
  Payload ID: 3006
  Gene Symbol: CHD9
  Gene Name: chromodomain helicase DNA binding protein 9
  ENSP ID: ENSP00000460155
MTDPMMDFFDDANLFGETLEEENLLHQVESQTEPFTGLDPEDLLQEGLLPHFDESTFGQDNSSHILDHDLDRQFTSHLVTRPSDMAQTQLQ

SEQ ID NO: 15305 - protein, 113 aa, Homo sapiens
  Payload ID: 3006
  Gene Symbol: CHD9
  Gene Name: chromodomain helicase DNA binding protein 9
  ENSP ID: ENSP00000462008
  MOD_RES (1)..(1): Any amino acid
XPALSYTQPQGIPDTESPVPVINLKDGTRLAGDDAPKRKDLEKWLKEHPGYVEDLGAFIPRMQLHEGRPKQKRHRCRNPNKLDVNSLTGEERVQLINRRNARKIRKLRLKEIY

SEQ ID NO: 15306 - protein, 122 aa, Homo sapiens
  Payload ID: 3006
  Gene Symbol: CHD9
  Gene Name: chromodomain helicase DNA binding protein 9
  ENSP ID: ENSP00000462685
  MOD_RES (1)..(1): Any amino acid
XPNHVSLGLTSSQISTGINPALSYTQPQGIPDTESPVPVINLKDGTRLAGDDAPKRKDLEKWLKEHPGYVEDLGAFIPRMQLHEGRPKQKRHRCRNPNKLDVNSLTGEERVQLINRRNARKA

SEQ ID NO: 15307 - protein, 963 aa, Homo sapiens
  Payload ID: 3006
  Gene Symbol: CHD9
  Gene Name: chromodomain helicase DNA binding protein 9
  ENSP ID: ENSP00000478361
MLYYLKQEVIGNECQKVFDGVDASDIDVWVPEPDHSEVPAEWWDFDADKSLLIGVFKHGYEKYNTIRADPALCFLERVGKPDEKAVAAEQRANDYMDGDVEDPEYKPAPAIFKDDIEDDVSSPGDLVIADGDGQLMEGDKVYWPTQSALTTRLRRLITAYQRTNKNRQIQQIQPTFSVPTSVMQPIYEEATLNPKMAAKIERQQRWTRREEADFYRVVSTFGVVFDPDRGQFDWTKFRAMARLHKKTDDSLEKYLYAFMSMCRRVCRLPSKEESTTHMKAYDEESVASLSTTQDETQDSFQMNNGTPESAYILQGGYMLAASYWPKDRVMINRLDSICQTVLKGKWPSARRSYDANTVASFYTTKLLDSPGAATEYSDPSVPTPPGAGVKEEHDQSTQMSKVKKHVREKEFTVKIKDEGGLKLTFQKQGLAQKRPFDGEDGALGQQQYLTRLRELQSASETSLVNFPKSIPVSGTSIQPTLGANGVILDNQPIVKKRRGRRKNVEGVDIFFFNRNKPPNHVSLGLTSSQISTGINPALSYTQPQGIPDTESPVPVINLKDGTRLAGDDAPKRKDLEKWLKEHPGYVEDLGAFIPRMQLHEGRPKQKRHRCRNPNKLDVNSLTGEERVQLINRRNARKVGGAFAPPLKDLCRFLKENSEYGVAPEWGDVVKQSGFLPESMYERILTGPVVREEVSRRGRRPKSGIAKATAAAAAASATSVSGNPLLANGLLPGVDLTTLQALQQNLQNLQSLQVTAGLMGMPTGLPSGGEAKNMAAMFPMLLSGMAGLPNLLGMGGLLTKPTESGTEDKKGSDSKESEGKTERTESQSSENGGENSVSSSPSTSSTAALNTAAAANPLALNPLLLSNILYPGMLLTPGLNLHIPTLSQSNTFDVQNKNSDLGSSKSVEVKEEDSRIKDQEDKGGTEPSPLNENSTDEGSEKADASSGSDSTSSSSEDSDSSNED

SEQ ID NO: 15308 - protein, 963 aa, Homo sapiens; identical to SEQ ID NO: 15307
  Payload ID: 3006
  Gene Symbol: CHD9
  Gene Name: chromodomain helicase DNA binding protein 9
  ENSP ID: ENSP00000482842

SEQ ID NO: 15309 - protein, 598 aa, Homo sapiens
  Payload ID: 3007
  Gene Symbol: CDYL
  Gene Name: chromodomain protein, Y-like
  Uniprot ID: Q9Y232
  ENSP ID: ENSP00000330512
MTFQASHRSAWGKSRKKNWQYEGPTQKLFLKRNNVSAPDGPSDPSISVSSEQSGAQQPPALQVERIVDKRKNKKGKTEYLVRWKGYDSEDDTWEPEQHLVNCEEYIHDFNRRHTEKQKESTLTRTNRTSPNNARKQISRSTNSNFSKTSPKALVIGKDHESKNSQLFAASQKFRKNTAPSLSSRKNMDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAVNGPAIGLGASILPLCDVVWANEKAWFQTPYTTFGQSPDGCSTVMFPKIMGGASANEMLLSGRKLTAQEACGKGLVSQVFWPGTFTQEVMVRIKELASCNPVVLEESKALVRCNMKMELEQANERECEVLKKIWGSAQGMDSMLKYLQRKIDEF

SEQ ID NO: 15310 - protein, 412 aa, Homo sapiens
  Payload ID: 3007
  Gene Symbol: CDYL
  Gene Name: chromodomain protein, Y-like
  Uniprot ID: Q9Y232
  ENSP ID: ENSP00000340908
MDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAVNGPAIGLGASILPLCDVVWANEKAWFQTPYTTFGQSPDGCSTVMFPKIMGGASANEMLLSGRKLTAQEACGKGLVSQVFWPGTFTQEVMVRIKELASCNPVVLEESKALVRCNMKMELEQANERECEVLKKIWGSAQGMDSMLKYLQRKIDEF

SEQ ID NO: 15311 - protein, 544 aa, Homo sapiens
  Payload ID: 3007
  Gene Symbol: CDYL
  Gene Name: chromodomain protein, Y-like
  Uniprot ID: Q9Y232
  ENSP ID: ENSP00000380718
MASEELYEVERIVDKRKNKKGKTEYLVRWKGYDSEDDTWEPEQHLVNCEEYIHDFNRRHTEKQKESTLTRTNRTSPNNARKQISRSTNSNFSKTSPKALVIGKDHESKNSQLFAASQKFRKNTAPSLSSRKNMDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAVNGPAIGLGASILPLCDVVWANEKAWFQTPYTTFGQSPDGCSTVMFPKIMGGASANEMLLSGRKLTAQEACGKGLVSQVFWPGTFTQEVMVRIKELASCNPVVLEESKALVRCNMKMELEQANERECEVLKKIWGSAQGMDSMLKYLQRKIDEF

SEQ ID NO: 15312 - protein, 412 aa, Homo sapiens; identical to SEQ ID NO: 15310
  Payload ID: 3007
  Gene Symbol: CDYL
  Gene Name: chromodomain protein, Y-like
  Uniprot ID: Q9Y232
  ENSP ID: ENSP00000394076

SEQ ID NO: 15313 - protein, 171 aa, Homo sapiens
  Payload ID: 3007
  Gene Symbol: CDYL
  Gene Name: chromodomain protein, Y-like
  ENSP ID: ENSP00000394740
MLAYNNGSRSGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAV

SEQ ID NO: 15314 - protein, 507 aa, Homo sapiens
  Payload ID: 3008
  Gene Symbol: CDYL2
  Gene Name: chromodomain protein, Y-like 2
  ENSP ID: ENSP00000454546
MASGDLYEVERIVDKRKNKKGKWEYLIRWKGYGSTEDTWEPEHHLLHCEEFIDEFNGLHMSKDKRIKSGKQSSTSKLLRDSRGPSVEKLSHRPSDPGKSKGTSHKRKRINPPLAKPKKGYSGKPSSGGDRATKTVSYRTTPSGLQIMPLKKSQNGMENGDAGSEKDERHFGNGSHQPGLDLNDHVGEQDMGECDVNHATLAENGLGGSALTNGGLNLHSPVKRKLEAEKDYVFDKRLRYSVRQNESNCRFRDIVVRKEEGFTHILLSSQTSDNNALTPEIMKEVRRALCNAATDDSKLLLLSAVGSVFCSGLDYSYLIGRLSSDRRKESTRIAEAIRDFVKAFIQFKKPIVVAINGPALGLGASILPLCDIVWASEKAWFQTPYATIRLTPAGCSSYTFPQILGVALANEMLFCGRKLTAQEACSRGLVSQVFWPTTFSQEVMLRVKEMASCSAVVLEESKCLVRSFLKSVLEDVNEKECLMLKQLWSSSKGLDSLFSYLQDKIYEV

SEQ ID NO: 15315 - protein, 507 aa, Homo sapiens; identical to SEQ ID NO: 15314
  Payload ID: 3008
  Gene Symbol: CDYL2
  Gene Name: chromodomain protein, Y-like 2
  ENSP ID: ENSP00000455111

SEQ ID NO: 15316 - protein, 507 aa, Homo sapiens; identical to SEQ ID NO: 15314
  Payload ID: 3008
  Gene Symbol: CDYL2
  Gene Name: chromodomain protein, Y-like 2
  ENSP ID: ENSP00000456934

SEQ ID NO: 15317 - protein, 506 aa, Homo sapiens
  Payload ID: 3008
  Gene Symbol: CDYL2
  Gene Name: chromodomain protein, Y-like 2
  Uniprot ID: Q8N8U2
  ENSP ID: ENSP00000476295
MASGDLYEVERIVDKRKNKKGKWEYLIRWKGYGSTEDTWEPEHHLLHCEEFIDEFNGLHMSKDKRIKSGKQSSTSKLLRDSRGPSVEKLSHRPSDPGKSKGTSHKRKRINPPLAKPKKGYSGKPSSGGDRATKTVSYRTTPSGLQIMPLKKSQNGMENGDAGSEKDERHFGNGSHQPGLDLNDHVGEQDMGECDVNHATLAENGLGSALTNGGLNLHSPVKRKLEAEKDYVFDKRLRYSVRQNESNCRFRDIVVRKEEGFTHILLSSQTSDNNALTPEIMKEVRRALCNAATDDSKLLLLSAVGSVFCSGLDYSYLIGRLSSDRRKESTRIAEAIRDFVKAFIQFKKPIVVAINGPALGLGASILPLCDIVWASEKAWFQTPYATIRLTPAGCSSYTFPQILGVALANEMLFCGRKLTAQEACSRGLVSQVFWPTTFSQEVMLRVKEMASCSAVVLEESKCLVRSFLKSVLEDVNEKECLMLKQLWSSSKGLDSLFSYLQDKIYEV

SEQ ID NO: 15318 - protein, 554 aa, Homo sapiens
  Payload ID: 3009
  Gene Symbol: CDY1
  Gene Name: chromodomain protein, Y-linked, 1
  Uniprot ID: Q9Y6F8
  ENSP ID: ENSP00000302968
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNRKLFAASKNVRRKAASILSDTKNMEIINSTIETLAPDSPFDHKTVSGFQKLEKLDPIAADQQDTVVFKVTEGKLLRDPLSRPGAEQTGIQNKTQIHPLMSQMSGSVTASMATGSATRKGIVVLIDPLAANGTTDMHTSVPRVKGGQRNITDDSRDQPFIKKMHFTIRLTESASTYRDIVVKKEDGFTQIVLSTRSTEKNALNTEVIKEIVNALNSAAADDSKLVLFSAAGSVFCCGLDFGYFVKHLRNNRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNPIVLEECKALVRCNIKLELEQANERECEVLRKIWSSAQGIESMLKIPLLGYKAAFPPRKTQNDQRWCP

SEQ ID NO: 15319 - protein, 540 aa, Homo sapiens
  Payload ID: 3009
  Gene Symbol: CDY1
  Gene Name: chromodomain protein, Y-linked, 1
  Uniprot ID: Q9Y6F8
  ENSP ID: ENSP00000354799
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNRKLFAASKNVRRKAASILSDTKNMEIINSTIETLAPDSPFDHKTVSGFQKLEKLDPIAADQQDTVVFKVTEGKLLRDPLSRPGAEQTGIQNKTQIHPLMSQMSGSVTASMATGSATRKGIVVLIDPLAANGTTDMHTSVPRVKGGQRNITDDSRDQPFIKKMHFTIRLTESASTYRDIVVKKEDGFTQIVLSTRSTEKNALNTEVIKEIVNALNSAAADDSKLVLFSAAGSVFCCGLDFGYFVKHLRNNRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNPIVLEECKALVRCNIKLELEQANERECEVLRKIWSSAQGIESMLKYVENKIDEF

SEQ ID NO: 15320 - protein, 554 aa, Homo sapiens; identical to SEQ ID NO: 15318
  Payload ID: 3010
  Gene Symbol: CDY1B
  Gene Name: chromodomain protein, Y-linked, 1B
  Uniprot ID: Q9Y6F8
  ENSP ID: ENSP00000303178

SEQ ID NO: 15321 - protein, 540 aa, Homo sapiens; identical to SEQ ID NO: 15319
  Payload ID: 3010
  Gene Symbol: CDY1B
  Gene Name: chromodomain protein, Y-linked, 1B
  Uniprot ID: Q9Y6F8
  ENSP ID: ENSP00000371844

SEQ ID NO: 15322 - protein, 541 aa, Homo sapiens
  Payload ID: 3011
  Gene Symbol: CDY2A
  Gene Name: chromodomain protein, Y-linked, 2A
  Uniprot ID: Q9Y6F7
  ENSP ID: ENSP00000250838
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNCKLFAASKNVRRKAASTLSDTKNMEIINSTIETLAPDSPFDHKKTVSGFQKLEKLDPIAADQQDTVVFKVTEGKLLRDPLSHPGAEQTGIQNKTQMHPLMSQMSGSVTASMATGSATRKGIVVLIDPLAANGTTDMHTSVPRVKGGQRNITDDSRGQPFIKKMHFTIRLTESAITYRDIVVKKEDGFTQIVLSTRSTEKNALNTEVIKEMVNALNSAAADDSKLVLFSAAGSVFCCGLDFGYFVRHLRNDRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNAIVLEECKALVRCNIKLELEQANERECEVLRKIWSSAQGIESMLKYVENKIDEF

SEQ ID NO: 15323 - protein, 555 aa, Homo sapiens
  Payload ID: 3011
  Gene Symbol: CDY2A
  Gene Name: chromodomain protein, Y-linked, 2A
  ENSP ID: ENSP00000402280
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNCKLFAASKNVRRKAASTLSDTKNMEIINSTIETLAPDSPFDHKKTVSGFQKLEKLDPIAADQQDTVVFKVTEGKLLRDPLSHPGAEQTGIQNKTQMHPLMSQMSGSVTASMATGSATRKGIVVLIDPLAANGTTDMHTSVPRVKGGQRNITDDSRGQPFIKKMHFTIRLTESAITYRDIVVKKEDGFTQIVLSTRSTEKNALNTEVIKEMVNALNSAAADDSKLVLFSAAGSVFCCGLDFGYFVRHLRNDRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNAIVLEECKALVRCNIKLELEQANERECEVLRKIWSSAQGIESMLKIPLLGYKAAFPPRKTQNDQRWCP

SEQ ID NO: 15324 - protein, 541 aa, Homo sapiens; identical to SEQ ID NO: 15322
  Payload ID: 3012
  Gene Symbol: CDY2B
  Gene Name: chromodomain protein, Y-linked, 2B
  Uniprot ID: Q9Y6F7
  ENSP ID: ENSP00000372319

SEQ ID NO: 15325 - protein, 555 aa, Homo sapiens; identical to SEQ ID NO: 15323
  Payload ID: 3012
  Gene Symbol: CDY2B
  Gene Name: chromodomain protein, Y-linked, 2B
  ENSP ID: ENSP00000441273

SEQ ID NO: 15326 - protein, 457 aa, Homo sapiens
  Payload ID: 3013
  Gene Symbol: CHGA
  Gene Name: chromogranin A
  Uniprot ID: P10645
  ENSP ID: ENSP00000216492
MRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 15327 - protein, 306 aa, Homo sapiens
  Payload ID: 3013
  Gene Symbol: CHGA
  Gene Name: chromogranin A
  ENSP ID: ENSP00000334023
MRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKGRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 15328 - protein, 38 aa, Homo sapiens
  Payload ID: 3013
  Gene Symbol: CHGA
  Gene Name: chromogranin A
  ENSP ID: ENSP00000450801
MRSAAVLALLLCAGQVTALPVNSPMNKGDTEMNGSFPF

SEQ ID NO: 15329 - protein, 457 aa, Homo sapiens; identical to SEQ ID NO: 15326
  Payload ID: 3013
  Gene Symbol: CHGA
  Gene Name: chromogranin A
  Uniprot ID: P10645
  ENSP ID: ENSP00000478198

SEQ ID NO: 15330 - protein, 38 aa, Homo sapiens; identical to SEQ ID NO: 15328
  Payload ID: 3013
  Gene Symbol: CHGA
  Gene Name: chromogranin A
  ENSP ID: ENSP00000486340

SEQ ID NO: 15331 - protein, 306 aa, Homo sapiens; identical to SEQ ID NO: 15327
  Payload ID: 3013
  Gene Symbol: CHGA
  Gene Name: chromogranin A
  ENSP ID: ENSP00000486710

SEQ ID NO: 15332 - protein, 677 aa, Homo sapiens
  Payload ID: 3014
  Gene Symbol: CHGB
  Gene Name: chromogranin B
  Uniprot ID: P05060
  ENSP ID: ENSP00000368244
MQPTLLLSLLGAVGLAAVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEETGSQENHPQESKGQPRSQEESEEGEEDATSEVDKRRTRPRHHHGRSRPDRSSQGGSLPSEEKGHPQEESEESNVSMASLGEKRDHHSTHYRASEEEPEYGEEIKGYPGVQAPEDLEWERYRGRGSEEYRAPRPQSEESWDEEDKRNYPSLELDKMAHGYGEESEEERGLEPGKGRHHRGRGGEPRAYFMSDTREEKRFLGEGHHRVQENQMDKARRHPQGAWKELDRNYLNYGEEGAPGKWQQQGDLQDTKENREEARFQDKQYSSHHTAEKRKRLGELFNPYYDPLQWKSSHFERRDNMNDNFLEGEEENELTLNEKNFFPEYNYDWWEKKPFSEDVNWGYEKRNLARVPKLDLKRQYDRVAQLDQLLHYRKKSAEFPDFYDSEEPVSTHQEAENEKDRADQTVLTEDEKKELENLAAMDLELQKIAEKFSQRG

SEQ ID NO: 15333 - protein, 289 aa, Homo sapiens
  Payload ID: 3014
  Gene Symbol: CHGB
  Gene Name: chromogranin B
  ENSP ID: ENSP00000416643
MPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEETGSQENHPQESKGQPRSQEESEEGEEDATSEVDKRRTRPRHHHGRSRPDRSSQGGSLPSEEKGHPQE

SEQ ID NO: 15334 - protein, 147 aa, Homo sapiens
  Payload ID: 3015
  Gene Symbol: C1orf100
  Gene Name: chromosome 1 open reading frame 100
  Uniprot ID: Q5SVJ3
  ENSP ID: ENSP00000311218
MTAIRLREFIERRPVIPPSIFIAHQGRDVQGYYPGQLARLHFDHSAKRAPRPLIDLTIPPKTKYHYQPQLDQQTLIRYICLRRHSKPAEPWYKETTYRRDYSLPFYEIDWNQKLATVSLNPRPLNSLPELYCCEERSSFERNAFKLK

SEQ ID NO: 15335 - protein, 115 aa, Homo sapiens
  Payload ID: 3015
  Gene Symbol: C1orf100
  Gene Name: chromosome 1 open reading frame 100
  Uniprot ID: Q5SVJ3
  ENSP ID: ENSP00000355495
MTAIRLREFIERRPVIPPSIFIAHQGRDVQGYYPGQLARLHFDHSAKRAPRHSKPAEPWYKETTYRRDYSLPFYEIDWNQKLATVSLNPRPLNSLPELYCCEERSSFERNAFKLK

SEQ ID NO: 15336 - protein, 800 aa, Homo sapiens
  Payload ID: 3016
  Gene Symbol: C1orf101
  Gene Name: chromosome 1 open reading frame 101
  Uniprot ID: Q5SY80
  ENSP ID: ENSP00000355489
MATLGQKPVIHTVLKRKVYSSNEKMRRGTWRIVVPMTKDDALKEIRGNQVTFQDCFIADFLILLTFPLLTIPEIPGYLPISSPRGSQLMASWDACVVASAVLVTDMETFHTTDSFKSWTRIRVPPDILSDDERRSVAHVILSRDGIVFLINGVLYIKSFRGFIRLGGIVNLPDGGITGISSRKWCWVNYLLKAKGRRSTFAVWTENEIYLGSILLKFARLVTTTELKNILSLSVTATLTIDRVEYTGHPLEIAVFLNYCTVCNVTKKIFLVIYNEDTKQWVSQDFTLDAPIDSVTMPHFTFSALPGLLLWNKHSIYYCYHNFTFTGILQTPAGHGNLSMLSNDSIIHEVFIDYYGDILVKMENNVIFYSKINTRDAVKLHLWTNYTTRAFIFLSTSGQTYFLYALDDGTIQIQDYPLHLEAQSIAFTTKDKCPYMAFHNNVAHVFYFLDKGEALTVWTQIVYPENTGLYVIVESYGPKILQESHEISFEAAFGYCTKTLTLTFYQNVDYERISDYFETQDKHTGLVLVQFRPSEYSKACPIAQKVFQIAVGCDDKKFIAIKGFSKKGCHHHDFSYVIEKSYLRHQPSKNLRVRYIWGEYGCPLRLDFTEKFQPVVQLFDDNGYVKDVEANFIVWEIHGRDDYSFNNTMAQSGCLHEAQTWKSMIELNKHLPLEEVWGPENYKHCFSYAIGKPGDLNQPYEIINSSNGNHIFWPMGHSGMYVFRVKILDPNYSFCNLTAMFAIETFGLIPSPSVYLVASFLFVLMLLFFTILVLSYFRYMRIYRRYIYEPLHKPQRKRKKN

SEQ ID NO: 15337 - protein, 832 aa, Homo sapiens
  Payload ID: 3016
  Gene Symbol: C1orf101
  Gene Name: chromosome 1 open reading frame 101
  Uniprot ID: Q5SY80
  ENSP ID: ENSP00000355491
MSAREVAVLLLWLSCYGSALWRYSTNSPNYRIFSTRSTIKLEYEGTLFTEWSVPETCFVLNKSSPTTELRCSSPGVHAIKPIVTGPDEEERYLFVESSHTCFLWYYRVRHFFNNFTQLITVWAYDPESADPDELLGNAEEPSINSIVLSTQMATLGQKPVIHTVLKRKVYSSNEKMRRGTWRIVVPMTKDDALKEIRGNQVTFQDCFIADFLILLTFPLLTIPEIPGYLPISSPRGSQLMASWDACVVASAVLVTDMETFHTTDSFKSWTRIRVPPDILSDDERRSVAHVILSRDGIVFLINGVLYIKSFRGFIRLGGIVNLPDGGITGISSRKWCWVNYLLKAKGRRSTFAVWTENEIYLGSILLKFARLVTTTELKNILSLSVTATLTIDRVEYTGHPLEIAVFLNYCTVCNVTKKIFLVIYNEDTKQWVSQDFTLDAPIDSVTMPHFTFSALPGLLLWNKHSIYYCYHNFTFTGILQTPAGHGNLSMLSNDSIIHEVFIDYYGDILVKMENNVIFYSKINTRDAVKLHLWTNYTTRAFIFLSTSGQTYFLYALDDGTIQIQDYPLHLEAQSIAFTTKDKCPYMAFHNNVAHVFYFLDKGEALTVWTQIVYPENTGLYVIVESYGPKILQESHEISFEAAFGYCTKTLTLTFYQNVDYERISDYFETQDKHTGLVLVQFRPSEYSKACPIAQKVFQIAVGCDDKKFIAIKGFSKKGCHHHDFSYVIEKSYLRHQPSKNLRVRYIWGEYGCPLRLDFTEKFQPVVQLFDDNGYVKDVEANFIVWEIHGRDDYSFNNTMAQSGCLHEAQTWKSMIELNKHLPLEEVWGPEFL

SEQ ID NO: 15338 - protein, 951 aa, Homo sapiens
  Payload ID: 3016
  Gene Symbol: C1orf101
  Gene Name: chromosome 1 open reading frame 101
  Uniprot ID: Q5SY80
  ENSP ID: ENSP00000355492
MSAREVAVLLLWLSCYGSALWRYSTNSPNYRIFSTRSTIKLEYEGTLFTEWSVPETCFVLNKSSPTTELRCSSPGVHAIKPIVTGPDEEERYLFVESSHTCFLWYYRVRHFFNNFTQLITVWAYDPESADPDELLGNAEEPSINSIVLSTQMATLGQKPVIHTVLKRKVYSSNEKMRRGTWRIVVPMTKDDALKEIRGNQVTFQDCFIADFLILLTFPLLTIPEIPGYLPISSPRGSQLMASWDACVVASAVLVTDMETFHTTDSFKSWTRIRVPPDILSDDERRSVAHVILSRDGIVFLINGVLYIKSFRGFIRLGGIVNLPDGGITGISSRKWCWVNYLLKAKGRRSTFAVWTENEIYLGSILLKFARLVTTTELKNILSLSVTATLTIDRVEYTGHPLEIAVFLNYCTVCNVTKKIFLVIYNEDTKQWVSQDFTLDAPIDSVTMPHFTFSALPGLLLWNKHSIYYCYHNFTFTGILQTPAGHGNLSMLSNDSIIHEVFIDYYGDILVKMENNVIFYSKINTRDAVKLHLWTNYTTRAFIFLSTSGQTYFLYALDDGTIQIQDYPLHLEAQSIAFTTKDKCPYMAFHNNVAHVFYFLDKGEALTVWTQIVYPENTGLYVIVESYGPKILQESHEISFEAAFGYCTKTLTLTFYQNVDYERISDYFETQDKHTGLVLVQFRPSEYSKACPIAQKVFQIAVGCDDKKFIAIKGFSKKGCHHHDFSYVIEKSYLRHQPSKNLRVRYIWGEYGCPLRLDFTEKFQPVVQLFDDNGYVKDVEANFIVWEIHGRDDYSFNNTMAQSGCLHEAQTWKSMIELNKHLPLEEVWGPENYKHCFSYAIGKPGDLNQPYEIINSSNGNHIFWPMGHSGMYVFRVKILDPNYSFCNLTAMFAIETFGLIPSPSVYLVASFLFVLMLLFFTILVLSYFRYMRIYRRYIYEPLHKPQRKRKKN

SEQ ID NO: 15339 - protein, 871 aa, Homo sapiens
  Payload ID: 3016
  Gene Symbol: C1orf101
  Gene Name: chromosome 1 open reading frame 101
  ENSP ID: ENSP00000395796
RRRSRRHVSPGSGRAAAVAELLWLRPLEIKLEYEGTLFTEWSVPETCFVLNKSSPTTELRCSSPGVHAIKPIVTGPDEEERYLFVESSHTCFLWYYRVRTWRIVVPMTKDDALKEIRGNQVTFQDCFIADFLILLTFPLLTIPEIPGYLPISSPRGSQLMASWDACVVASAVLVTDMETFHTTDSFKSWTRIRVPPDILSDDERRSVAHVILSRDGIVFLINGVLYIKSFRGFIRLGGIVNLPDGGITGISSRKWCWVNYLLKAKGRRSTFAVWTENEIYLGSILLKFARLVTTTELKNILSLSVTATLTIDRVEYTGHPLEIAVFLNYCTVCNVTKKIFLVIYNEDTKQWVSQDFTLDAPIDSVTMPHFTFSALPGLLLWNKHSIYYCYHNFTFTGILQTPAGHGNLSMLSNDSIIHEVFIDYYGDILVKMENNVIFYSKINTRDAVKLHLWTNYTTRAFIFLSTSGQTYFLYALDDGTIQIQDYPLHLEAQSIAFTTKDKCPYMAFHNNVAHVFYFLDKGEALTVWTQIVYPENTGLYVIVESYGPKILQESHEISFEAAFGYCTKTLTLTFYQNVDYERISDYFETQDKHTGLVLVQFRPSEYSKACPIAQKVFQIAVGCDDKKFIAIKGFSKKGCHHHDFSYVIEKSYLRHQPSKNLRVRYIWGEYGCPLRLDFTEKFQPVVQLFDDNGYVKDVEANFIVWEIHGRDDYSFNNTMAQSGCLHEAQTWKSMIELNKHLPLEEVWGPENYKHCFSYAIGKPGDLNQPYEIINSSNGNHIFWPMGHSGMYVFRVKILDPNYSFCNLTAMFAIETFGLIPSPSVYLVASFLFVLMLLFFTILVLSYFRYMRIYRRYIYEPLHKPQRKRKKN

SEQ ID NO: 15340 - protein, 173 aa, Homo sapiens
  Payload ID: 3017
  Gene Symbol: C1orf105
  Gene Name: chromosome 1 open reading frame 105
  ENSP ID: ENSP00000356698
MEEMRPAGHGVSNVCVAFKVACHSCLPRLFNALIPSPDRNGAALLGGQASADSKSEARRNQCDSMLLRNQQLCSTCQEMKMVQPRTMKIPDDPKASFENCMSYRMSLHQPKFQTTPEPFHDDIPTESIHYRLPILGPRTAVFHGLLTEAYKTLKERQRSSLPRKEPIGKTTRQ

SEQ ID NO: 15341 - protein, 183 aa, Homo sapiens
  Payload ID: 3017
  Gene Symbol: C1orf105
  Gene Name: chromosome 1 open reading frame 105
  Uniprot ID: O95561
  ENSP ID: ENSP00000356700
MEKRELKASVPKFDKIPWLSEASLVNKPLVLSLPRRYPHTSATFLTSSKKNMNLPILFQVPDVLSKARRNQCDSMLLRNQQLCSTCQEMKMVQPRTMKIPDDPKASFENCMSYRMSLHQPKFQTTPEPFHDDIPTESIHYRLPILGPRTAVFHGLLTEAYKTLKERQRSSLPRKEPIGKTTRQ

SEQ ID NO: 15342 - protein, 125 aa, Homo sapiens
  Payload ID: 3017
  Gene Symbol: C1orf105
  Gene Name: chromosome 1 open reading frame 105
  ENSP ID: ENSP00000431442
VLSLPRRYPHTSATFLTSSKKNMNLPILFQVPDVLSKARRNQCDSMLLRNQQLCSTCQEMKMVQPRTMKIPDDPKASFENCMSYRMSLHQPKFQTTPEPFHDDIPTGSVHNIWLKTFHGDGVQTK

SEQ ID NO: 15343 - protein, 37 aa, Homo sapiens
  Payload ID: 3017
  Gene Symbol: C1orf105
  Gene Name: chromosome 1 open reading frame 105
  ENSP ID: ENSP00000435216
MEKRELKIYSKHTEQYLSYSLNPCASSPQRGMPQYQN

SEQ ID NO: 15344 - protein, 663 aa, Homo sapiens
  Payload ID: 3018
  Gene Symbol: C1orf106
  Gene Name: chromosome 1 open reading frame 106
  Uniprot ID: Q3KP66
  ENSP ID: ENSP00000356311
MLQMPKLNEIPPGRAGRREARGEGRWPGQTGPEAARLEWRAQGQAGGARAPWDSWGSSRLPTQPGPGWSRCPPSLLCALSFQKSTMESKDEVSDTDSGIILQSGPDSPVSPMKELTHAVHKQQRALEARLEACLEELRRLCLREAELTGTLPAEYPLKPGEKAPKVRRRIGAAYKLDDWALHREDPLSSLERQLALQLQITEAARRLCLEENLSRQARRQRKHSMLQEEKKLQELQRCLVERRRNSEPPPAAALPLGRELSASDDSSLSDGLLLEEEESQVPKPPPESPAPPSRPLPPQTLEGLQPTGPEAGSPERAPVQNSPWKETSLDHPYEKPRKSSEPWSESSSPATTPQDGPSASSLWLLEPASYHVVPIRGVPGQWQGRTSAPATPEIQGRRGQSQSLRVDSFRAGPEGRGRSAFPRRRPTHYTVTVPDSCFPATKPPLPHAACHSCSEDSGSDVSSISHPTSPGSSSPDISFLQPLSPPKTHRHRGAWVPAGSRELVAHHPKLLLPPGYFPAGRYVVVAESPLPPGEWELRRAAPGPAYEEEGTPLRYQRLVPSRSRIVRTPSLKDSPAGRGLSKAAVSEELKWWHERARLRSTRPHSLDRQGAFRVRSLPLGREGFGRALGPRAQVPTVCVLRRSPDGAPVQVFVPEKGEIISQV

SEQ ID NO: 15345 - protein, 578 aa, Homo sapiens
  Payload ID: 3018
  Gene Symbol: C1orf106
  Gene Name: chromosome 1 open reading frame 106
  Uniprot ID: Q3KP66
  ENSP ID: ENSP00000392105
MESKDEVSDTDSGIILQSGPDSPVSPMKELTHAVHKQQRALEARLEACLEELRRLCLREAELTGTLPAEYPLKPGEKAPKVRRRIGAAYKLDDWALHREDPLSSLERQLALQLQITEAARRLCLEENLSRQARRQRKHSMLQEEKKLQELQRCLVERRRNSEPPPAAALPLGRELSASDDSSLSDGLLLEEEESQVPKPPPESPAPPSRPLPPQTLEGLQPTGPEAGSPERAPVQNSPWKETSLDHPYEKPRKSSEPWSESSSPATTPQDGPSASSLWLLEPASYHVVPIRGVPGQWQGRTSAPATPEIQGRRGQSQSLRVDSFRAGPEGRGRSAFPRRRPTHYTVTVPDSCFPATKPPLPHAACHSCSEDSGSDVSSISHPTSPGSSSPDISFLQPLSPPKTHRHRGAWVPAGSRELVAHHPKLLLPPGYFPAGRYVVVAESPLPPGEWELRRAAPGPAYEEEGTPLRYQRLVPSRSRIVRTPSLKDSPAGRGLSKAAVSEELKWWHERARLRSTRPHSLDRQGAFRVRSLPLGREGFGRALGPRAQVPTVCVLRRSPDGAPVQVFVPEKGEIISQV

SEQ ID NO: 15346 - protein, 123 aa, Homo sapiens
  Payload ID: 3018
  Gene Symbol: C1orf106
  Gene Name: chromosome 1 open reading frame 106
  ENSP ID: ENSP00000397255
MESKDEVSDTDSGIILQSGPDSPVSPMKELTHAVHKQQRALEARLEACLEELRRLCLREAELTGTLPAEYPLKPGEKAPKVRRRIGAAYKLDDWALHREDPLSSLERQLALQLQITEAARRLC

SEQ ID NO: 15347 - protein, 40 aa, Homo sapiens
  Payload ID: 3018
  Gene Symbol: C1orf106
  Gene Name: chromosome 1 open reading frame 106
  ENSP ID: ENSP00000431682
MESKDEVSDTDSGIILQSGPDSPVSPMKELTHAVHKQQRA

SEQ ID NO: 15348 - protein, 203 aa, Homo sapiens
  Payload ID: 3019
  Gene Symbol: C1orf109
  Gene Name: chromosome 1 open reading frame 109
  Uniprot ID: Q9NX04
  ENSP ID: ENSP00000350704
MTQDRPLLAVQEALKKCFPVVEEQQGLWQSALRDCQPLLSSLSNLAEQLQAAQNLRFEDVPALRAFPDLKERLRRKQLVAGDIVLDKLGERLAILLKVRDMVSSHVERVFQIYEQHADTVGIDAVLQPSAVSPSVADMLEWLQDIERHYRKSYLKRKYLLSSIQWGDLANIQALPKAWDRISKDEHQDLVQDILLNVSFFLEE

SEQ ID NO: 15349 - protein, 142 aa, Homo sapiens
  Payload ID: 3019
  Gene Symbol: C1orf109
  Gene Name: chromosome 1 open reading frame 109
  ENSP ID: ENSP00000476341
MTQDRPLLAVQEALKKCFPVVEEQQGLWQSALRDCQPLLSSLSNLAEQLQAAQNLRFEDVPALRAFPDLKERLRRKQLVAGDIVLDKLGERLAILLKVRDMVSSHVERVFQIYEQHADTVGIDAVLQPSAVSPSVADMLEWL

SEQ ID NO: 15350 - protein, 113 aa, Homo sapiens
  Payload ID: 3019
  Gene Symbol: C1orf109
  Gene Name: chromosome 1 open reading frame 109
  ENSP ID: ENSP00000476779
MTQDRPLLAVQEALKKCFPVVEEQQGLWQSALRDCQPLLSSLSNLAEQLQAAQNLRFEDVPALRAFPDLKERLRRKQLVAGDIVLDKLGERLAILLKVRDMVSSHVERVFQIY

SEQ ID NO: 15351 - protein, 151 aa, Homo sapiens
  Payload ID: 3019
  Gene Symbol: C1orf109
  Gene Name: chromosome 1 open reading frame 109
  ENSP ID: ENSP00000476934
MTQDRPLLAVQEALKKCFPVVEEQQGLWQSALRDCQPLLSSLSNLAEQLQAAQNLRFEDVPALRAFPDLKERLRRKQLVAGDIVLDKLGERLAILLKVRDMVSSHVERVFQIYEQHADTVGIDAVLQPSAVSPSVADMLEWLQDIERHYRK

SEQ ID NO: 15352 - protein, 191 aa, Homo sapiens
  Payload ID: 3019
  Gene Symbol: C1orf109
  Gene Name: chromosome 1 open reading frame 109
  ENSP ID: ENSP00000477011
MTQDRPLLAVQEALKKCFPVVEEQQGLWQSALRDCQPLLSSLSNLAEQLQAAQNLRFEDVPALRAFPDLKERLRRKQLVAGDIVLDKLGERLAILLKVRDMVSSHVERVFQIYEQHADTVGIDAVLQPSAVSPSVADMLEWLQDIERHYRKSYLKRKYLLSSIQWGDLANIQALPKAWDRISKDEHQDLVQ

SEQ ID NO: 15353 - protein, 91 aa, Homo sapiens
  Payload ID: 3019
  Gene Symbol: C1orf109
  Gene Name: chromosome 1 open reading frame 109
  ENSP ID: ENSP00000477078
MTQDRPLLAVQEALKKCFPVVEEQQGLWQSALRDCQPLLSSLSNLAEQLQAAQNLRFEDVPALRAFPDLKERLRRKQLVAGDIVLDKLGER

SEQ ID NO: 15354 - protein, 203 aa, Homo sapiens; identical to SEQ ID NO: 15348
  Payload ID: 3019
  Gene Symbol: C1orf109
  Gene Name: chromosome 1 open reading frame 109
  Uniprot ID: Q9NX04
  ENSP ID: ENSP00000477159

SEQ ID NO: 15355 - protein, 113 aa, Homo sapiens
  Payload ID: 3019
  Gene Symbol: C1orf109
  Gene Name: chromosome 1 open reading frame 109
  Uniprot ID: Q9NX04
  ENSP ID: ENSP00000477273
MTQDRPLLAVQEALKKCFPVVEEQQGLWQSALRDCQPLLSSLSNLAEQLQAAQNLRFEDVPALRAFPDLKERLRQPSSSRCETWSAAMWSECFRSMSNTQTQLALMLSCSLQQ

SEQ ID NO: 15356 - protein, 37 aa, Homo sapiens
  Payload ID: 3019
  Gene Symbol: C1orf109
  Gene Name: chromosome 1 open reading frame 109
  ENSP ID: ENSP00000479011
MTQDRPLLAVQEALKKCFPVVEEQQGLWQSALRDCQP

SEQ ID NO: 15357 - protein, 261 aa, Homo sapiens
  Payload ID: 3020
  Gene Symbol: C1orf111
  Gene Name: chromosome 1 open reading frame 111
  Uniprot ID: Q5T0L3
  ENSP ID: ENSP00000356912
MENFSLLSISGPPISSSALSAFPDIMFSRATSLPDIAKTAVPTEASSPAQALPPQYQSIIVRQGIQNTALSPDCSLGDTQHGEKLRRNCTIYRPWFSPYSYFVCADKESQLEAYDFPEVQQDEGKWDNCLSEDMAENICSSSSSPENTCPREATKKSRHGLDSITSQDILMASRWHPAQQNGYKCVACCRMYPTLDFLKSHIKRGFREGFSCKVYYRKLKALWSKEQKARLGDRLSSGSCQAFNSPAEHLRQIGGEAYLCL

SEQ ID NO: 15358 - protein, 40 aa, Homo sapiens
  Payload ID: 3020
  Gene Symbol: C1orf111
  Gene Name: chromosome 1 open reading frame 111
  ENSP ID: ENSP00000476996
MENFSLLSISGPPISSSALSAFPDIMFSRATSLPGKLWCH

SEQ ID NO: 15359 - protein, 243 aa, Homo sapiens
  Payload ID: 3020
  Gene Symbol: C1orf111
  Gene Name: chromosome 1 open reading frame 111
  ENSP ID: ENSP00000484851
MENFSLLSISGPPISSSALSAFPDIMFSRATSLPDIAKTAVPTEASSPAQALPPQYQSIIVRQGIQNTALSPDCSLGDTQHGEKLRRNCTIYRPWFSPYSYFVCADKESQLEAYDFPEVQQDEGKWDNCLSEDMAENICSSSSSPENTCPREATKKSRHGLDSITSQDILMASRWHPAQQNGYKCVACCRMYPTLDFLKSHIKRGFREGFSCKVYYRKLKALWSKAEGPAGRQALLRQLPGLQ

SEQ ID NO: 15360 - protein, 853 aa, Homo sapiens
  Payload ID: 3021
  Gene Symbol: C1orf112
  Gene Name: chromosome 1 open reading frame 112
  Uniprot ID: Q9NSG2
  ENSP ID: ENSP00000286031
MFLPHMNHLTLEQTFFSQVLPKTVKLFDDMMYELTSQARGLSSQNLEIQTTLRNILQTMVQLLGALTGCVQHICATQESIILENIQSLPSSVLHIIKSTFVHCKNSESVYSGCLHLVSDLLQALFKEAYSLQKQLMELLDMVCMDPLVDDNDDILNMVIVIHSLLDICSVISSMDHAFHANTWKFIIKQSLKHQSIIKSQLKHKDIITSLCEDILFSFHSCLQLAEQMTQSDAQDNADYRLFQKTLKLCRFFANSLLHYAKEFLPFLSDSCCTLHQLYLQIHSKFPPSLYATRISKAHQEEIAGAFLVTLDPLISQLLTFQPFMQVVLDSKLDLPCELQFPQCLLLVVVMDKLPSQPKEVQTLWCTDSQVSETTTRISLLKAVFYSFEQCSGELSLPVHLQGLKSKGKAEVAVTLYQHVCVHLCTFITSFHPSLFAELDAALLNAVLSANMITSLLAMDAWCFLARYGTAELCAHHVTIVAHLIKSCPGECYQLINLSILLKRLFFFMAPPHQLEFIQKFSPKEAENLPLWQHISFQALPPELREQTVHEVTTVGTAECRKWLSRSRTLGELESLNTVLSALLAVCNSAGEALDTGKQTAIIEVVSQLWAFLNIKQVADQPYVQQTFSLLLPLLGFFIQTLDPKLILQAVTLQTSLLKLELPDYVRLAMLDFVSSLGKLFIPEAIQDRILPNLSCMFALLLADRSWLLEQHTLEAFTQFAEGTNHEEIVPQCLSSEETKNKVVSFLEKTGFVDETEAAKVERVKQEKGIFWEPFANVTVEEAKRSSLQPYAKRARQEFPWEEEYRSALHTIAGALEATESLLQKGPAPAWLSMEMEALQERMDKLKRYIHTLG

SEQ ID NO: 15361 - protein, 853 aa, Homo sapiens; identical to SEQ ID NO: 15360
  Payload ID: 3021
  Gene Symbol: C1orf112
  Gene Name: chromosome 1 open reading frame 112
  Uniprot ID: Q9NSG2
  ENSP ID: ENSP00000352276

SEQ ID NO: 15362 - protein, 530 aa, Homo sapiens
  Payload ID: 3021
  Gene Symbol: C1orf112
  Gene Name: chromosome 1 open reading frame 112
  Uniprot ID: Q9NSG2
  ENSP ID: ENSP00000389257
MQVVLDSKLDLPCELQFPQCLLLVVVMDKLPSQPKEVQTLWCTDSQVSETTTRISLLKAVFYSFEQCSGELSLPVHLQGLKSKGKAEVAVTLYQHVCVHLCTFITSFHPSLFAELDAALLNAVLSANMITSLLAMDAWCFLARYGTAELCAHHVTIVAHLIKSCPGECYQLINLSILLKRLFFFMAPPHQLEFIQKFSPKEAENLPLWQHISFQALPPELREQTVHEVTTVGTAECRKWLSRSRTLGELESLNTVLSALLAVCNSAGEALDTGKQTAIIEVVSQLWAFLNIKQVADQPYVQQTFSLLLPLLGFFIQTLDPKLILQAVTLQTSLLKLELPDYVRLAMLDFVSSLGKLFIPEAIQDRILPNLSCMFALLLADRSWLLEQHTLEAFTQFAEGTNHEEIVPQCLSSEETKNKVVSFLEKTGFVDETEAAKVERVKQEKGIFWEPFANVTVEEAKRSSLQPYAKRARQEFPWEEEYRSALHTIAGALEATESLLQKGPAPAWLSMEMEALQERMDKLKRYIHTLG

SEQ ID NO: 15363 - protein, 142 aa, Homo sapiens
  Payload ID: 3022
  Gene Symbol: C1orf115
  Gene Name: chromosome 1 open reading frame 115
  Uniprot ID: Q9H7X2
  ENSP ID: ENSP00000294889
MTVGARLRSKAESSLLRRGPRGRGRTEGDEEAAAILEHLEYADEAEAAAESGTSAADERGPGTRGARRVHFALLPERYEPLEEPAPSEQPRKRYRRKLKKYGKNVGKVIIKGCRYVVIGLQGFAAAYSAPFAVATSVVSFVR

SEQ ID NO: 15364 - protein, 601 aa, Homo sapiens
  Payload ID: 3023
  Gene Symbol: C1orf116
  Gene Name: chromosome 1 open reading frame 116
  Uniprot ID: Q9BW04
  ENSP ID: ENSP00000352447
MPERELWPAGTGSEPVTRVGSCDSMMSSTSTRSGSSDSSYDFLSTEEKECLLFLEETIGSLDTEADSGLSTDESEPATTPRGFRALPITQPTPRGGPEETITQQGRTPRTVTESSSSHPPEPQGLGLRSGSYSLPRNIHIARSQNFRKSTTQASSHNPGEPGRLAPEPEKEQVSQSSQPRQAPASPQEAALDLDVVLIPPPEAFRDTQPEQCREASLPEGPGQQGHTPQLHTPSSSQEREQTPSEAMSQKAKETVSTRYTQPQPPPAGLPQNARAEDAPLSSGEDPNSRLAPLTTPKPRKLPPNIVLKSSRSSFHSDPQHWLSRHTEAAPGDSGLISCSLQEQRKARKEALEKLGLPQDQDEPGLHLSKPTSSIRPKETRAQHLSPAPGLAQPAAPAQASAAIPAAGKALAQAPAPAPGPAQGPLPMKSPAPGNVAASKSMPISIPKAPRANSALTPPKPESGLTLQESNTPGLRQMNFKSNTLERSGVGLSSYLSTEKDASPKTSTSLGKGSFLDKISPSVLRNSRPRPASLGTGKDFAGIQVGKLADLEQEQSSKRLSYQGQSRDKLPRPPCVSVKISPKGVPNEHRREALKKLGLLKE

SEQ ID NO: 15365 - protein, 355 aa, Homo sapiens
  Payload ID: 3023
  Gene Symbol: C1orf116
  Gene Name: chromosome 1 open reading frame 116
  Uniprot ID: Q9BW04
  ENSP ID: ENSP00000436862
MSQKAKETVSTRYTQPQPPPAGLPQNARAEDAPLSSGEDPNSRLAPLTTPKPRKLPPNIVLKSSRSSFHSDPQHWLSRHTEAAPGDSGLISCSLQEQRKARKEALEKLGLPQDQDEPGLHLSKPTSSIRPKETRAQHLSPAPGLAQPAAPAQASAAIPAAGKALAQAPAPAPGPAQGPLPMKSPAPGNVAASKSMPISIPKAPRANSALTPPKPESGLTLQESNTPGLRQMNFKSNTLERSGVGLSSYLSTEKDASPKTSTSLGKGSFLDKISPSVLRNSRPRPASLGTGKDFAGIQVGKLADLEQEQSSKRLSYQGQSRDKLPRPPCVSVKISPKGVPNEHRREALKKLGLLKE

SEQ ID NO: 15366 - protein, 110 aa, Homo sapiens
  Payload ID: 3024
  Gene Symbol: C1orf122
  Gene Name: chromosome 1 open reading frame 122
  Uniprot ID: Q6ZSJ8
  ENSP ID: ENSP00000362133
MEWGPGSDWSRGEAAGVDRGKAGLGLGGRPPPQPPREERAQQLLDAVEQRQRQLLDTIAACEEMLRQLGRRRPEPAGGGNVSAKPGAPPQPAVSARGGFPKDAGDGAAEP

SEQ ID NO: 15367 - protein, 47 aa, Homo sapiens
  Payload ID: 3024
  Gene Symbol: C1orf122
  Gene Name: chromosome 1 open reading frame 122
  Uniprot ID: Q6ZSJ8
  ENSP ID: ENSP00000362134
MLRQLGRRRPEPAGGGNVSAKPGAPPQPAVSARGGFPKDAGDGAAEP

SEQ ID NO: 15368 - protein, 47 aa, Homo sapiens; identical to SEQ ID NO: 15367
  Payload ID: 3024
  Gene Symbol: C1orf122
  Gene Name: chromosome 1 open reading frame 122
  Uniprot ID: Q6ZSJ8
  ENSP ID: ENSP00000434520

SEQ ID NO: 15369 - protein, 160 aa, Homo sapiens
  Payload ID: 3025
  Gene Symbol: C1orf123
  Gene Name: chromosome 1 open reading frame 123
  Uniprot ID: Q9NWV4
  ENSP ID: ENSP00000294360
MGKIALQLKATLENITNLRPVGEDFRWYLKMKCGNCGEISDKWQYIRLMDSVALKGGRGSASMVQKCKLCARENSIEILSSTIKPYNAEDNENFKTIVEFECRGLEPVDFQPQAGFAAEGVESGTAFSDINLQEKDWTDYDEKAQESVGIYEVTHQFVKC

SEQ ID NO: 15370 - protein, 823 aa, Homo sapiens
  Payload ID: 3026
  Gene Symbol: C1orf127
  Gene Name: chromosome 1 open reading frame 127
  ENSP ID: ENSP00000366203
MWGSPALAWAVWLACVQPTVFPWSLSFRSDTDKPSSAAEVLTEASSCWTDTVECFSDYMTLWIPRSHVEGLRRWLARTLHLPGTWRSPDHLDSSLAKCGYFLHLASDGDFLFRVQYSACFVQKEKANYRLEIRIFQKGVMGLERSDRYIMKCPMLRSRLGQESVHCGPMFIQVSRPLPLWRDNRQTPWLLSLRGELVASLEDASLMGLYVDMNATTVTVQSPRQGLLQRWEVLNTSAELLPLWLVSGHHAYSLEAACPPVSFQPESEVLVHIPKQRLGLVKRGSYIEETLSLRFLRVHQSNIFMVTENKDFVVVSIPAAGVLQVQRCQEVGGTPGTQAFYRVDLSLEFAEMAAPVLWTVESFFQCVGSGTESPASTAALRTTPSPPSPGPETPPAGVPPAASSQVWAAGPAAQEWLSRDLLHRPSDALAKKGLGPFLQTAKPARRGQTSASILPRVVQAQRGPQPPPGEAGIPGHPTPPATLPSEPVEGVQASPWRPRPVLPTHPALTLPVSSDASSPSPPAPRPERPESLLVSGPSVTLTEGLGTVRPEQDPAKSPGSPLLLRGLSSGDVAAPEPIMGEPGQASEEFQPLARPWRATLAAEELVSHRSPGEPQETCSGTEVERPRQTGPGLPREGARGHMDLSSSEPSQDIEGPGLSILPARDATFSTPSVRQPDPSAWLSSGPELTGMPRVRLAAPLAVLPMEPLPPEPVRPAALLTPEASSVGGPDQARYLESAPGWPVGQEEWGVAHTSSPPSTQTLSLWAPTGVLLPSLVELEYPFQAGRGASLQQELTEPTLALSAESHRPPELQDSVEGLSERPSR

SEQ ID NO: 15371 - protein, 658 aa, Homo sapiens
  Payload ID: 3026
  Gene Symbol: C1orf127
  Gene Name: chromosome 1 open reading frame 127
  ENSP ID: ENSP00000387816
  MOD_RES (1)..(1): Any amino acid
XIMKCPMLRSRLGQESVHCGPMFIQVSRPLPLWRDNRQTPWLLSLRGELVASLEDASLMGLYVDMNATTVTVQSPRQGLLQRWEVSGGQQALPGVSFQPESEVLVHIPKQRLGLVKRGSYIEETLSLRFLRVHQSNIFMVTENKDFVVVSIPAAGVLQVQRCQEVGGTPGTQAFYRVDLSLEFAEMAAPVLWTVESFFQCVGSGTESPASTAALRTTPSPPSPGPETPPAGVPPAASSQVWAAGPAAQEWLSRDLLHRPSDALAKKGLGPFLQTAKPARRGQTSASILPRVVQAQRGPQPPPGEAGIPGHPTPPATLPSEPVEGVQASPWRPRPVLPTHPALTLPVSSDASSPSPPAPRPERPESLLVSGPSVTLTEGLGTVRPEQDPAKSPGSPLLLRGLSSGDVAAPEPIMGEPGQASEEFQPLARPWRATLAAEELVSHRSPGEPQETCSGTEVERPRQTGPGLPREGARGHMDLSSSEPSQDIEGPGLSILPARDATFSTPSVRQPDPSAWLSSGPELTGMPRVRLAAPLAVLPMEPLPPEPVRPAALLTPEASSVGGPDQARYLESAPGWPVGQEEWGVAHTSSPPSTQTLSLWAPTGVLLPSLVELEYPFQAGRGASLQQELTEPTLALSAESHRPPELQDSVEGLSERPSR

SEQ ID NO: 15372 - protein, 775 aa, Homo sapiens
  Payload ID: 3026
  Gene Symbol: C1orf127
  Gene Name: chromosome 1 open reading frame 127
  ENSP ID: ENSP00000429704
  MOD_RES (1)..(1): Any amino acid
XSLSFRSDTDKPSSAAEVLTEASSCWTDTVECFSDYMTLWIPRSHVEGLRRWLARTLHLPGTWRSPDHLDSSLAKCGYFLHLASDGDFLFRVQYSACFVQKEKANYRLEIRIFQKGVMGLERSDRYIMKCPMLRSRLGQESVHCGPMFIQVSRPLPLWRDNRQTPWLLSLRGELVASLEDASLMGLYVDMNATTVTVQSPRQGLLQRWEVLNTSAELLPLWLVSGHHAYSLEAACPPVSFQPESEVLVHIPKQRLGLVKRGSYIEETLSLRFLRVHQSNIFMVTENKDFVVVSIPAAGVLQVQRCQEVGGTPGTQAFYRVDLSLEFAEMAAPVLWTVESFFQCVGSGTESPASTAALRTTPSPPSPGPETPPAGVPPAASSQKGLGPFLQTAKPARRGQTSASILPRVVQAQRGPQPPPGEAGIPGHPTPPATLPSEPVEGVQASPWRPRPVLPTHPALTLPVSSDASSPSPPAPRPERPESLLVSGPSVTLTEGLGTVRPEQDPAKSPGSPLLLRGLSSGDVAAPEPIMGEPGQASEEFQPLARPWRATLAAEELVSHRSPGEPQETCSGTEVERPRQTGPGLPREGARGHMDLSSSEPSQDIEGPGLSILPARDATFSTPSVRQPDPSAWLSSGPELTGMPRVRLAAPLAVLPMEPLPPEPVRPAALLTPEASSVGGPDQARYLESAPGWPVGQEEWGVAHTSSPPSTQTLSLWAPTGVLLPSLVELEYPFQAGRGASLQQELTEPTLALSAESHRPPELQDSVEGLSERPSR

SEQ ID NO: 15373 - protein, 69 aa, Homo sapiens
  Payload ID: 3026
  Gene Symbol: C1orf127
  Gene Name: chromosome 1 open reading frame 127
  ENSP ID: ENSP00000467607
  MOD_RES (1)..(1): Any amino acid
XPSTQTLSLWAPTGVLLPSLVELEYPFQAGRGASLQQELTEPTLALSAESHRPPELQDSVEGLSERPSR

SEQ ID NO: 15374 - protein, 249 aa, Homo sapiens
  Payload ID: 3027
  Gene Symbol: C1orf131
  Gene Name: chromosome 1 open reading frame 131
  ENSP ID: ENSP00000321341
MRVDSSADPTMSQEQGPGSSTPPSSPTLLDALLQNLYDFGGTEGETEQKKIIKKRENKKRDVMASAALAAEPSPLPGSLIRGQRKSASSFFKELREERHCAPSGTPTGPEILAAAVPPSSLKNNREQVEVVEFHSNKKRKLTPDHNKNTKQANPSVLERDVDTQEFNLEKARLEVHRFGITGYGKGKERILEQERAIMLGAKPPKKSYVNYKVLQEQIKEKKAAKEEEKRLAQETDIFKKKKRKGQEDR

SEQ ID NO: 15375 - protein, 293 aa, Homo sapiens
  Payload ID: 3027
  Gene Symbol: C1orf131
  Gene Name: chromosome 1 open reading frame 131
  Uniprot ID: Q8NDD1
  ENSP ID: ENSP00000355609
MRVDSSADPTMSQEQGPGSSTPPSSPTLLDALLQNLYDFGGTEGETEQKKIIKKRENKKRDVMASAALAAEPSPLPGSLIRGQRKSASSFFKELREERHCAPSGTPTGPEILAAAVPPSSLKNNREQVEVVEFHSNKKRKLTPDHNKNTKQANPSVLERDVDTQEFNLEKARLEVHRFGITGYGKGKERILEQERAIMLGAKPPKKSYVNYKVLQEQIKEKKAAKEEEKRLAQETDIFKKKKRKGQEDRKSKKKSAPSILSNGRIGQVGKFKNGTLILSPVDIKKINSSRVAK

SEQ ID NO: 15376 - protein, 292 aa, Homo sapiens
  Payload ID: 3027
  Gene Symbol: C1orf131
  Gene Name: chromosome 1 open reading frame 131
  Uniprot ID: Q8NDD1
  ENSP ID: ENSP00000355611
MRVDSSADPTMSQEQGPGSSTPPSSPTLLDALLQNLYDFGGTEGETEQKKIIKKRENKKRDVMASAALAAEPSPLPGSLIRGQRKSASSFFKELREERHCAPSGTPTGPEILAAAVPPSSLKNNREQVEVVEFHSNKKRKLTPDHNKNTKANPSVLERDVDTQEFNLEKARLEVHRFGITGYGKGKERILEQERAIMLGAKPPKKSYVNYKVLQEQIKEKKAAKEEEKRLAQETDIFKKKKRKGQEDRKSKKKSAPSILSNGRIGQVGKFKNGTLILSPVDIKKINSSRVAK

SEQ ID NO: 15377 - protein, 256 aa, Homo sapiens
  Payload ID: 3027
  Gene Symbol: C1orf131
  Gene Name: chromosome 1 open reading frame 131
  ENSP ID: ENSP00000401677
GSSTPPSSPTLLDALLQNLYDFGGTEGETEQKKIIKKRENKKRDVMASAALAAEPSPLPGSLIRGQRKSASSFFKELREERHCAPSGTPTGPEILAAAVPPSSLKNNREQVEVVEFHSNKKRKLTPDHNKNTKARLEVHRFGITGYGKGKERILEQERAIMLGAKPPKKSYVNYKVLQEQIKEKKAAKEEEKRLAQETDIFKKKKRKGQEDRKSKKKSAPSILSNGRIGQVGKFKNGTLILSPVDIKKINSSRVAK

SEQ ID NO: 15378 - protein, 400 aa, Homo sapiens
  Payload ID: 3028
  Gene Symbol: C1orf141
  Gene Name: chromosome 1 open reading frame 141
  Uniprot ID: Q5JVX7
  ENSP ID: ENSP00000360045
MAEKILEKLDVLDKQAEIILARRTKINRLQSEGRKTTMAIPLTFDFQLEFEEALATSASKAISKIKEDKSCSITKSKMHVSFKCEPEPRKSNFEKSNLRPFFIQTNVKNKESESTAQIEKKPRKPLDSVGLLEGDRNKRKKSPQMNDFNIKENKSVRNYQLSKYRSVRKKSLLPLCFEDELKNPHAKIVNVSPTKTVTSHMEQKDTNPIIFHDTEYVRMLLLTKNRFSSHPLENENIYPHKRTNFILERNCEILKSIIGNQSISLFKPQKTMPTVQRKDIQIPMSFKAGHTTVDDKLKKKTNKQTLENRSWNTLYNFSQNFSSLTKQFVGYLDKAVIHEMSAQTGKFERMFSAGKPTSIPTSSALPVKCYSKPFKYIYELNNVTPLDNLLNLSNEILNAS

SEQ ID NO: 15379 - protein, 400 aa, Homo sapiens; identical to SEQ ID NO: 15378
  Payload ID: 3028
  Gene Symbol: C1orf141
  Gene Name: chromosome 1 open reading frame 141
  Uniprot ID: Q5JVX7
  ENSP ID: ENSP00000360046

SEQ ID NO: 15380 - protein, 287 aa, Homo sapiens
  Payload ID: 3028
  Gene Symbol: C1orf141
  Gene Name: chromosome 1 open reading frame 141
  ENSP ID: ENSP00000415519
MAEKILEKLDVLDKQAEIILARRTKINRLQSEGRKTTMAIPLTFDFQLEFEEALATSASKAISKIKEDKSCSITKSKMHVSFKCEPEPRKSNFEKSNLRPFFIQTNVKNKESESTEPVEEHLKSRSIRPYLYLKDTTEMENAGPLNVLYSQHRQACRRSLGSTDFSPMFNIQSNAHKKEKDSTLFTAQIEKKPRKPLDSVGLLEGDRNKRKKSPQMNDFNIKENKSVRNYQLSKYRSVRKKSLLPLCFEDELKNPHAKIVNVSPTKTVTSHMEQKDTNPIIFHDTEY

SEQ ID NO: 15381 - protein, 217 aa, Homo sapiens
  Payload ID: 3028
  Gene Symbol: C1orf141
  Gene Name: chromosome 1 open reading frame 141
  ENSP ID: ENSP00000432856
MAEKILEKLDVLDKQAEIILARRTKINRLQSEGRKTTMAIPLTFDFQLEFEEALATSASKAISKIKEDKSCSITKSKMHVSFKCEPEPRKSNFEKSNLRPFFIQTNVKNKESESTEPVEEHLKSRSIRPYLYLKDTTEMENAGPLNVLYSQHRQACRRSLGSTDFSPMFNIQSNAHKKEKDSTLFTAQIEKKPRKPLDSVGLLEGDRNKRNKRTQIP

SEQ ID NO: 15382 - protein, 118 aa, Homo sapiens
  Payload ID: 3028
  Gene Symbol: C1orf141
  Gene Name: chromosome 1 open reading frame 141
  ENSP ID: ENSP00000444018
MAEKILEKLDVLDKQAEIILARRTKINRLQSEGRKTTMAIPLTFDFQLEFEEALATSASKAISKIKEDKSCSITKSKMHVSFKCEPEPRKSNFEKSNLRPFFIQTNVKNKESESTVIF

SEQ ID NO: 15383 - protein, 195 aa, Homo sapiens
  Payload ID: 3028
  Gene Symbol: C1orf141
  Gene Name: chromosome 1 open reading frame 141
  ENSP ID: ENSP00000474902
MAEKILEKLDVLDKQAEIILARRTKINRLQSEGRKTTMAIPLTFDFQLEFEEALATSASKAISKIKEDKSCSITKSKMHVSFKCEPEPRKSNFEKSNLRPFFIQTNVKNKESESTEPVEEHLKSRSIRPYLYLKDTTEMENAGPLNVLYSQHRQACRRSLGSTDFSPMFNIQSNAHKKEKDSTLFTAQIEKKPRK

SEQ ID NO: 15384 - protein, 80 aa, Homo sapiens
  Payload ID: 3028
  Gene Symbol: C1orf141
  Gene Name: chromosome 1 open reading frame 141
  Uniprot ID: Q5JVX7
  ENSP ID: ENSP00000481294
MAEKILEKLDVLDKQAEIILARRTKINRLQSEGRKTTMAIPLTFDFQLEFEEALATSASKAISKIKEDKSCSITKSKISN

SEQ ID NO: 15385 - protein, 113 aa, Homo sapiens
  Payload ID: 3029
  Gene Symbol: C1orf145
  Gene Name: chromosome 1 open reading frame 145
  Uniprot ID: Q96MR7
  ENSP ID: ENSP00000295012
MYTASSSAETLRTVRRRSVPSSSMPYLALAHNRVSSLNHAASVDGWGTSHRNVADSFSRTSRSCSRFLKGTAGSARREDCYFEAYMGSWFLDPRIYQNLCILKFYGQPCGTQA

SEQ ID NO: 15386 - protein, 158 aa, Homo sapiens
  Payload ID: 3029
  Gene Symbol: C1orf145
  Gene Name: chromosome 1 open reading frame 145
  Uniprot ID: Q96MR7
  ENSP ID: ENSP00000338823
MYTASSSAETLRTVRRRSVPSSSMPYLALAHNRVSSLNHAASVDGWGTSHRNVADSFSRTSRSCSRFLKGTAGSARREDWNGHLQPWIPRPDRRGWETADRKGERTQVHGLRRSLGPRAPHPGAHRALRPAQSCRSGPRGWTPCRCRGRGPTACRRGS

SEQ ID NO: 15387 - protein, 95 aa, Homo sapiens
  Payload ID: 3029
  Gene Symbol: C1orf145
  Gene Name: chromosome 1 open reading frame 145
  ENSP ID: ENSP00000435112
  MOD_RES (1)..(1): Any amino acid
XSSAETLRTVRRRSVPSSSMPYLALAHNRVSSLNHAASVDGWGTSHRNVADSFSRTSRSCSRFLKGTAGSARREDWRKEGFHSLLNVRREGIFHP

SEQ ID NO: 15388 - protein, 121 aa, Homo sapiens
  Payload ID: 3030
  Gene Symbol: C1orf146
  Gene Name: chromosome 1 open reading frame 146
  ENSP ID: ENSP00000359399
MDTKECLLSTEEIFLAKIEKFINIHQNSFLVLSAALHGPEEWKLMFRIQQRFLGCNLRILPVHNTVNAINLMCTIAKTTSKPYIDSICYRMITAKAYIIEQSPVWKTLQKIKLNSDSVNPN

SEQ ID NO: 15389 - protein, 180 aa, Homo sapiens
  Payload ID: 3030
  Gene Symbol: C1orf146
  Gene Name: chromosome 1 open reading frame 146
  Uniprot ID: Q5VVC0
  ENSP ID: ENSP00000359401
MAESGKEKIKWTTTIIISSSLKSYEVATALENRSHKVRYSDSVENGSIIFSLSGVAFLLMDTKECLLSTEEIFLAKIEKFINIHQNSFLVLSAALHGPEEWKLMFRIQQRFLGCNLRILPVHNTVNAINLMCTIAKTTSKPYIDSICYRMITAKAYIIEQSPVWKTLQKIKLNSDSVNPN

SEQ ID NO: 15390 - protein, 156 aa, Homo sapiens
  Payload ID: 3031
  Gene Symbol: C1orf158
  Gene Name: chromosome 1 open reading frame 158
  ENSP ID: ENSP00000365383
MFLTAVNPQPLSTPSWQIETKYSTKVLTGNWMEERRKGLPYKHLITHHQEPPHRYLISTYDDHYNRHGYNPGLPPLRTWNGQKLLWLPEKSDFPLLAPPTNYGLYEQLKQRQLTPKAGLKQSTYTSSYPRPPLCAMSWREHAVPVPPHRLHPLPHF

SEQ ID NO: 15391 - protein, 194 aa, Homo sapiens
  Payload ID: 3031
  Gene Symbol: C1orf158
  Gene Name: chromosome 1 open reading frame 158
  Uniprot ID: Q8N1D5
  ENSP ID: ENSP00000477802
MFLTAVNPQPLSTPSWQIETKYSTKVLTGNWMEERRKFTRDTDKTPQSIYRKEYIPFPDHRPDQISRWYGKRKVEGLPYKHLITHHQEPPHRYLISTYDDHYNRHGYNPGLPPLRTWNGQKLLWLPEKSDFPLLAPPTNYGLYEQLKQRQLTPKAGLKQSTYTSSYPRPPLCAMSWREHAVPVPPHRLHPLPHF

SEQ ID NO: 15392 - protein, 198 aa, Homo sapiens
  Payload ID: 3032
  Gene Symbol: C1orf159
  Gene Name: chromosome 1 open reading frame 159
  Uniprot ID: Q96HA4
  ENSP ID: ENSP00000368623
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSVRKPRYVRRERPLDRATDPAAFPGEARISNV

SEQ ID NO: 15393 - protein, 344 aa, Homo sapiens
  Payload ID: 3032
  Gene Symbol: C1orf159
  Gene Name: chromosome 1 open reading frame 159
  ENSP ID: ENSP00000368624
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSGNSSCRIPLWGFPSLGQSQGALWVCPQTGLPGSGSRPPLPGSPGDPPTRQGQGRIWLVPPALDLSWIWPAPPARPPLIPVTSMLFPVPETWGLQERRTHHDRADPQYLLLLEVQLHPRTDAAGLRQALLSSHRFSGAGSGGPKSQPVRKPRYVRRERPLDRATDPAAFPGEARISNV

SEQ ID NO: 15394 - protein, 189 aa, Homo sapiens
  Payload ID: 3032
  Gene Symbol: C1orf159
  Gene Name: chromosome 1 open reading frame 159
  Uniprot ID: Q96HA4
  ENSP ID: ENSP00000368629
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSDVGSAGKEDPPRQGRPPIPAPP

SEQ ID NO: 15395 - protein, 380 aa, Homo sapiens
  Payload ID: 3032
  Gene Symbol: C1orf159
  Gene Name: chromosome 1 open reading frame 159
  Uniprot ID: Q96HA4
  ENSP ID: ENSP00000368644
MALRHLALLAGLLVGVASKSMENTVTRNSTAVINTQAEGTLSPPGLSSLPVVREWALTHTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSGNSSCRIPLWGFPSLGQSQGALWVCPQTGLPGSGSRPPLPGSPGDPPTRQGQGRIWLVPPALDLSWIWPAPPARPPLIPVTSMLFPVPETWGLQERRTHHDRADPQYLLLLEVQLHPRTDAAGLRQALLSSHRFSGAGSGGPKSQPVRKPRYVRRERPLDRATDPAAFPGEARISNV

SEQ ID NO: 15396 - protein, 223 aa, Homo sapiens
  Payload ID: 3032
  Gene Symbol: C1orf159
  Gene Name: chromosome 1 open reading frame 159
  ENSP ID: ENSP00000390635
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSAPPEDRRSRPPPGPPEQPSLQWCWVRRTQESARTEAALRQAGAAPGQGHGSRCLPG

SEQ ID NO: 15397 - protein, 64 aa, Homo sapiens
  Payload ID: 3032
  Gene Symbol: C1orf159
  Gene Name: chromosome 1 open reading frame 159
  ENSP ID: ENSP00000395935
MALRHLALLAGLLVGVASKSMENTDTDVPAPEVLTRSTAGVRGACASQRGALRCLLGPAARVLC

SEQ ID NO: 15398 - protein, 198 aa, Homo sapiens; identical to SEQ ID NO: 15392
  Payload ID: 3032
  Gene Symbol: C1orf159
  Gene Name: chromosome 1 open reading frame 159
  Uniprot ID: Q96HA4
  ENSP ID: ENSP00000400736

SEQ ID NO: 15399 - protein, 57 aa, Homo sapiens
  Payload ID: 3032
  Gene Symbol: C1orf159
  Gene Name: chromosome 1 open reading frame 159
  ENSP ID: ENSP00000416740
MALRHLALLAGLLVGVASKSMENTAQLPECCVDVVGVNASCPGASLCGPGCYRRWNA

SEQ ID NO: 15400 - protein, 86 aa, Homo sapiens
  Payload ID: 3032
  Gene Symbol: C1orf159
  Gene Name: chromosome 1 open reading frame 159
  ENSP ID: ENSP00000462517
MALRHLALLAGLLVGVASKSMENTAQLPECCVDVVGVNASCPGASLCGPGCYRRWNADGSASCVRCGNGTLPAYNGSECRSFAGPG

SEQ ID NO: 15401 - protein, 98 aa, Homo sapiens
  Payload ID: 3032
  Gene Symbol: C1orf159
  Gene Name: chromosome 1 open reading frame 159
  ENSP ID: ENSP00000462798
MALRHLALLAGLLVGVASKSMENTDTDVPAPEVLTRSTAGVRGACASQRGALRCLLGERLLRNGWVRRGPHGEASWPAMGAPLPAVTAQRAAHRYRGV

SEQ ID NO: 15402 - protein, 111 aa, Homo sapiens
  Payload ID: 3032
  Gene Symbol: C1orf159
  Gene Name: chromosome 1 open reading frame 159
  ENSP ID: ENSP00000463144
MALRHLALLAGLLVGVASKSMENTDTDVPAPEVLTRSTAGVRGACASQRGALRCLLGPAARVLCGCGGRQRQLPRRKSVWSRLLQALERGRERQLRPLWERNPPSLQRLRV

SEQ ID NO: 15403 - protein, 103 aa, Homo sapiens
  Payload ID: 3032
  Gene Symbol: C1orf159
  Gene Name: chromosome 1 open reading frame 159
  ENSP ID: ENSP00000464273
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHP

SEQ ID NO: 15404 - protein, 14 aa, Homo sapiens
  Payload ID: 3032
  Gene Symbol: C1orf159
  Gene Name: chromosome 1 open reading frame 159
  ENSP ID: ENSP00000464657
MALRHLALLAGLLV

SEQ ID NO: 15405 - protein, 155 aa, Homo sapiens
  Payload ID: 3033
  Gene Symbol: C1orf162
  Gene Name: chromosome 1 open reading frame 162
  Uniprot ID: Q8NEQ5
  ENSP ID: ENSP00000344218
MGGNGSTCKPDTERQGTLSTAAPTTSPAPCLSNHHNKKHLILAFCAGVLLTLLLIAFIFLIIKSYRKYRRERLPISPGPLLRWVPLLSGTMADHSKPQAPDPHSDPPAKLSSIPGESLTYASTTFKLSEEKSNHLAENHSADFDPIVYAQIKVTN

SEQ ID NO: 15406 - protein, 130 aa, Homo sapiens
  Payload ID: 3033
  Gene Symbol: C1orf162
  Gene Name: chromosome 1 open reading frame 162
  Uniprot ID: Q8NEQ5
  ENSP ID: ENSP00000358732
MGGNGSTCKPDTERQGTLSTAAPTTSPAPCLSNHHNKKHLILAFCAGVLLTLLLIAFIFLIIKSYRKYHSKPQAPDPHSDPPAKLSSIPGESLTYASTTFKLSEEKSNHLAENHSADFDPIVYAQIKVTN

SEQ ID NO: 15407 - protein, 828 aa, Homo sapiens
  Payload ID: 3034
  Gene Symbol: C1orf167
  Gene Name: chromosome 1 open reading frame 167
  ENSP ID: ENSP00000317749
  MOD_RES (1)..(1): Any amino acid
XERETLRKATRATQRTGSFPQAWHSTAAGVAWVAPLSPQHQRAWLCRCFGAWQQFVQRGSRYRDHLADRRTGTLRKCLEQWVRMKQLRESDGAKVTQLSLCRQKAGREAVYTAGPGACGLGAVGQAQGQQEQGRGSLQDACWTLALCWALLLWKMRLFQRQWANSFFQGLQQRMLQRSLRWWHLRALGPDATSSCTKTPSALEPLSSSTLQDSLEKVPRAPTLPDTLQGSLLWAAGQRQQGQCLLLWQARAQQFQGTARWYQHTRQRRIFLSWSRWATAQWAWRELASHRAWDRTCRAVLGLWRQRLLQSRLVEWWAQERGWRLARDALCHWHSCWQGQQFLHEKCQTWVQVHLQGLQKVVFRSWQQAAAHQRCTVTRPEQLLLQSYFQAWCEVVRDTGVLRAQHQAFQDGLRRRALGAVFATWREAQEVAAGAQEQRVAQASLARWRSCGQQGQEDGQQKKARAPQAFPAWPVAPGMHHEAQQQAGESAGAQAAQCWTWCWALWVHESCRGQVSRAHASWKPRAWVLEASVQSAVRGGVQRAILTQLRPAELRRFLRTVQLRVRLGLPGAGKTRSCWTQATELVPPAPSLQCSLGGRRKPRGTAWAQRCREHSLCPAFQLWPQWPGQSSWVPGLPLWTRDQGPRAHSSPEPRACKAQSKAHKRRLRILEKQAQAHGSALLLALKGHDALGHQEEVPAAPVPRGTASRAAGFPAGQVPGSGMAALGGCPRGRAAGADPAQGVAPEMGLADVVAADPATASGSAVTAAGRWAFKKWHQRLAARSPRRGAASSPRPWSKPGPKGPESGQEAARAPRGWGLGAEHGAQLQL

SEQ ID NO: 15408 - protein, 616 aa, Homo sapiens
  Payload ID: 3034
  Gene Symbol: C1orf167
  Gene Name: chromosome 1 open reading frame 167
  ENSP ID: ENSP00000398213
  MOD_RES (1)..(1): Any amino acid
XRAPTLPDTLQGSLLWAAGQRQQGQCLLLWQARAQQFQGTARWYQHTRQRRIFLSWSRWATAQWAWRELASHRAWDRTCRAVLGLWRQRLLQSRLVEWWAQERGWRLARDALCHWHSCWQGQQFLHEKCQTWVQVHLQGLQKVVFRSWQQAAAHQRCTVTRPEQLLLQSYFQAWCEVVRDTGVLRAQHQAFQDGLRRRALGAVFATWREAQEVAAGAQEQRVAQASLARWRSCGQQGQEDGQQKKARAPQAFPAWPVAPGMHHEAQQQAGESAGAQAAQCWTWCWALWVHESCRGQVSRAHASWKPRAWVLEASVQSAVRGGVQRAILTQLRPAELRRFLRTVQLRVRLGLPGAGKTRSCWTQATELVPPAPSLQCSLGGRRKPRGTAWAQRCREHSLCPAFQLWPQWPGQSSWVPGLPLWTRDQGPRAHSSPEPRACKAQSKAHKRRLRARSCRILEKQAQAHGSALLLALKGHDALGHQEEVPAAPVPRGTASRAAGFPAGQVPGSGMAALGGCPRGRAAGADPAQGVAPEMGLADVVAADPATASGSAVTAAGRWAFKKWHQRLAARSPRRGAASSPRPWSKPGPKGPESGQEAARAPRGWGLGAEHGAQLQL

SEQ ID NO: 15409 - protein, 532 aa, Homo sapiens
  Payload ID: 3034
  Gene Symbol: C1orf167
  Gene Name: chromosome 1 open reading frame 167
  ENSP ID: ENSP00000399272
  MOD_RES (1)..(1): Any amino acid
XAAGQQPNGPGESWLPTGPGIGPAGLCWACGVSGCCSHGWWSGGPRSGAGGWHEMPYATGTPVGRQFLHEKCQTWVQVHLQGLQKVVFRSWQQAAAHQRCTVTRPEQLLLQSYFQAWCEVVRDTGVLRAQHQAFQDGLRRRALGAVFATWREAQEVAAGAQEQRVAQASLARWRSCGQQGQEDGQQKKARAPQAFPAWPVAPGMHHEAQQQAGESAGAQAAQCWTWCWALWVHESCRGQVSRAHASWKPRAWVLEASVQSAVRGGVQRAILTQLRPAELRRFLRTVQLRVRLGLPGAGKTRSCWTQATELVPPAPSLQCSLGGRRKPRGTAWAQRCREHSLCPAFQLWPQWPGQSSWVPGLPLWTRDQGPRAHSSPEPRACKAQSKAHKRRLRRKYLQRRCLEALLHGLRGSQQARCLAVAWQHWVDAQGAEQLVRTLLREWHLRWAWQTWWQRILRLRVAQQLQQQEDGPLRSGTNAWQPGAQGEELPVAQDPGASQAPRAPRVDRKPPEHRGVGGLGQSMGPSCSCDLFS

SEQ ID NO: 15410 - protein, 1468 aa, Homo sapiens
  Payload ID: 3034
  Gene Symbol: C1orf167
  Gene Name: chromosome 1 open reading frame 167
  Uniprot ID: Q5SNV9
  ENSP ID: ENSP00000414909
MTRMSCPWGSYQWEPGACPAAPRGIGGGDMAGGIPDVRGLQEAALGAGRSQEEARLVEEAQTPVMLPQDSGQRVEEVPGDLMAKRMSLILHVQKLPWDHVPCLRRTRQNLYQDVGGHAHGSGLGGAKRGAARSALRRPLPPATCRPAGIVSGPSPRLDSNPTGAHLIKQTRPLTVEWTKDTPVPEPMELRSDASHKENVSPKPAALPKPGKRLKQRRFRRSLGIGLSGRHDQWVPGCQVERGGPAATPSPGAVLDQEPCRVQTNLASPGPRLGLALKDTTGQLVNSSFWQQSNLQSLARRRQGKAREFAIQQSNLSINETSSPHLCPEPGGSSGPHKLPWGPLLSQEPLARPSSCLRQSGLPAPGTPSGDFRPTEAFAPLDGHTQPGLRSWGGLGSWRSRLVGEPLTLEDLAVPSQNQTQAPSRAAVHQLLASVHCLAQEAARLRCQAPQEPPAWGVSPKQKGEEGAPRERVHREEERTAFHLSDTVPASSASKNKAQNITAPESEAICWQLLSRCFRSWRHLVKRQREPAAAAVALGRWQLLRKCLQALWLREAQLEAAWGQYTKVLLVRSFREVSGLQVGPGGRVKQCPGSLREEEIAQRLLSHPRQRTDSRHERVQILQALQLAVFFLWCQQKKRARQERETLRKATRATQRTGSFPQAWHSTAAGVAWVAPLSPQHQRAWLCRCFGAWQQFVQRGSRYRDHLADRRTGTLRKCLEQWVRMKQLRESDGAKVTQLSLCRQKAGREAVYTAGPGACGLGAVGQAQGQQEQGRGSLQDACWTLALCWALLLWKMRLFQRQWANSFFQGLQQRMLQRSLRWWHLRALGPDATSSCTKTPSALEPLSSSTLQDSLEKVPRAPTLPDTLQGSLLWAAGQRQQGQCLLLWQARAQQFQGTARWYQHTRQRRIFLSWSRWATAQWAWRELASHRAWDRTCRAVLGLWRQRLLQSRLVEWWAQERGWRLARDALCHWHSCWQGQQFLHEKCQTWVQVHLQGLQKVVFRSWQQAAAHQRCTVTRPEQLLLQSYFQAWCEVVRDTGVLRAQHQAFQDGLRRRALGAVFATWREAQEVAAGAQEQRVAQASLARWRSCGQQGQEDGQQKKARAPQAFPAWPVAPGMHHEAQQQAGESAGAQAAQCWTWCWALWVHESCRGQVSRAHASWKPRAWVLEASVQSAVRGGVQRAILTQLRPAELRRFLRTVQLRVRLGLPGAGKTRSCWTQATELVPPAPSLQCSLGGRRKPRGTAWAQRCREHSLCPAFQLWPQWPGQSSWVPGLPLWTRDQGPRAHSSPEPRACKAQSKAHKRRLRILEKQAQAHGSALLLALKGHDALGHQEEVPAAPVPRGTASRAAGFPAGQVPGSGMAALGGCPRGRAAGADPAQGVAPEMGLADVVAADPATASGSAVTAAGRWAFKKWHQRLAARSPRRGAASSPRPWSKPGPKGPESGQEAARAPRGWGLGAEHGAQLQL

SEQ ID NO: 15411 - protein, 728 aa, Homo sapiens
  Payload ID: 3035
  Gene Symbol: C1orf168
  Gene Name: chromosome 1 open reading frame 168
  Uniprot ID: Q5VWT5
  ENSP ID: ENSP00000345972
MEGEGVRNFKELRAKFQNLDAPPLPGPIKFPAGVSPKGDIGGTQSTQILANGKPLSSNHKQRTPYCSSSESQPLQPQKIKLAQKSEIPKCSNSPGPLGKSTVCSATSSQKASLLLEVTQSNVEIITKEKVMVANSFRNKLWNWEKVSSQKSEMSSALLLANYGSKAIHLEGQKGMGLTPEEPRKKLETKGAQTLPSQKHVVAPKILHNVSEDPSFVISQHIRKSWENPPPERSPASSPCQPIYECELASQAPEKQPDVRHHHLPKTKPLPSIDSLGPPPPKPSRPPIVNLQAFQRQPAAVPKTQGEVTVEEGSLSPERLFNAEFEEPHNYEATISYLRHSGNSINLCTAKEIADPTYEVGIEELQKPGKNFPYPEPSAKHEDKKMKEKQPCELKPKNTEKEPYSNHVFKVDACEGTPEKIQMTNVHTGRRNMLAGKQEAMIDIIQTNPCPEGPKLARHSQGHCGHLEVLESTKETPDLGVSKTSSISEEIYDDVEYSRKEVPKLNYSSSLASSSEENRELYEDVYKTKNNYPKIDLDGKEALKRLQQFFKKEKDRFKIKKTKSKENLSAFSILLPDLELKSQEVIIYDDVDLSEKESKDEDKLKMWKPKFLTPKEKKEKNGAEESESFSPRNFFKTKKQNLEKNRMKREEKLFRERFKYDKEIIVINTAVACSNNSRNGIFDLPISPGEELEVIDTTEQNLVICRNSKGKYGYVLIEHLDFKHQSWSP

SEQ ID NO: 15412 - protein, 243 aa, Homo sapiens
  Payload ID: 3036
  Gene Symbol: C1orf174
  Gene Name: chromosome 1 open reading frame 174
  Uniprot ID: Q8IYL3
  ENSP ID: ENSP00000355306
MRSRKLTGAVRSSARLKARSCSAARLASAQEVAGSTSAKTACLTSSSHKATDTRTSKKFKCDKGHLVKSELQKLVPKNDSASLPKVTPETPCENEFAEGSALLPGSEAGVSVQQGAASLPLGGCRVVSDSRLAKTRDGLSVPKHSAGSGAEESNSSSTVQKQNEPGLQTEDVQKPPLQMDNSVFLDDDSNQPMPVSRFFGNVELMQDLPPASSSCPSMSRREFRKMHFRAKDDDDDDDDDAEM

SEQ ID NO: 15413 - protein, 199 aa, Homo sapiens
  Payload ID: 3037
  Gene Symbol: C1orf185
  Gene Name: chromosome 1 open reading frame 185
  Uniprot ID: Q5T7R7
  ENSP ID: ENSP00000360824
MASPKGFFNYLTYFLAAGAVTLGIGFFALASALWFLICKRREIFQNSKFKAIDERCRQRPSMAKIKSHSQCVFISRNFHTGRFQLQEEQRKKEAAHIKAIKDHSKDEPQLATKNIICDPSETSSTTNRSSVTLSLSTLPSDSYYSQSIEAADDWFSDDSLVKRNSPMPSLGEPLMEKVFSYLSTISLEEGTESVLNDTL

SEQ ID NO: 15414 - protein, 138 aa, Homo sapiens
  Payload ID: 3037
  Gene Symbol: C1orf185
  Gene Name: chromosome 1 open reading frame 185
  ENSP ID: ENSP00000473351
MAKIKSHSQCVFISRNFHTGRFQLQEEQRKKEAAHIKAIKDHSKDEPQLATKNIICDPSETSSTTNRSSVTLSLSTLPSDSYYSQSIEAADDWFSDDSLVKRNSPMPSLGEPLMEKVFSYLSTISLEEGTESVLNDTL

SEQ ID NO: 15415 - protein, 195 aa, Homo sapiens [sequence omitted]

SEQ ID NO: 15416 - protein, 172 aa, Homo sapiens
  Payload ID: 3038
  Gene Symbol: C1orf186
  Gene Name: chromosome 1 open reading frame 186
  Uniprot ID: Q6ZWK4
  ENSP ID: ENSP00000356093
MLTEVMEVWHGLVIAVVSLFLQACFLTAINYLLSRHMAHKSEQILKAASLQVPRPSPGHHHPPAVKEMKETQTERDIPMSDSLYRHDSDTPSDSLDSSCSSPPACQATEDVDYTQVVFSDPGELKNDSPLDYENIKEITDYVNVNPERHKPSFWYFVNPALSEPAEYDQVAM

SEQ ID NO: 15417 - protein, 172 aa, Homo sapiens; identical to SEQ ID NO: 15416
  Payload ID: 3038
  Gene Symbol: C1orf186
  Gene Name: chromosome 1 open reading frame 186
  Uniprot ID: Q6ZWK4
  ENSP ID: ENSP00000463990

SEQ ID NO: 15418 - protein, 124 aa, Homo sapiens
  Payload ID: 3038
  Gene Symbol: C1orf186
  Gene Name: chromosome 1 open reading frame 186
  ENSP ID: ENSP00000474759
MLTEVMEVWHGLVIAVVSLFLQACFLTAINYLLSRHMDDSDTPSDSLDSSCSSPPACQATEDVDYTQVVFSDPGELKNDSPLDYENIKEITDYVNVNPERHKPSFWYFVNPALSEPAEYDQVAM

SEQ ID NO: 15419 - protein, 172 aa, Homo sapiens; identical to SEQ ID NO: 15416
  Payload ID: 3038
  Gene Symbol: C1orf186
  Gene Name: chromosome 1 open reading frame 186
  Uniprot ID: Q6ZWK4
  ENSP ID: ENSP00000474994

SEQ ID NO: 15420 - protein, 101 aa, Homo sapiens
  Payload ID: 3039
  Gene Symbol: C1orf189
  Gene Name: chromosome 1 open reading frame 189
  Uniprot ID: Q5VU69
  ENSP ID: ENSP00000357511
MSVEKMTKVEESFQKAMGLKKTVDRWRNSHTHCLWQMALGQRRNPYATLRMQDTMVQELALAKKQLLMVRQAALHQLFEKEHQQYQQELNQMGKAFYVERF

SEQ ID NO: 15421 - protein, 130 aa, Homo sapiens
  Payload ID: 3040
  Gene Symbol: C1orf194
  Gene Name: chromosome 1 open reading frame 194
  ENSP ID: ENSP00000358961
MPPTRDPFQQPTLDNDDSYLGELRASKIPKDDLDFRLAALYNHHTGTFKNKSEILLNQKTTQDTYRTKIQFPGEFLTPPTPPITFLANIRHWINPKKESIHSIQGSIVSPHTAATNGGYSRKKDGGFFST

SEQ ID NO: 15422 - protein, 169 aa, Homo sapiens
  Payload ID: 3040
  Gene Symbol: C1orf194
  Gene Name: chromosome 1 open reading frame 194
  Uniprot ID: Q5T5A4
  ENSP ID: ENSP00000358964
MPPTRDPFQQPTLDNDDSYLGELRASKKLPYKNPTHLAQQQEPWSRLNSTPTITSMRRDAYYFDPEIPKDDLDFRLAALYNHHTGTFKNKSEILLNQKTTQDTYRTKIQFPGEFLTPPTPPITFLANIRHWINPKKESIHSIQGSIVSPHTAATNGGYSRKKDGGFFST

SEQ ID NO: 15423 - protein, 157 aa, Homo sapiens
  Payload ID: 3040
  Gene Symbol: C1orf194
  Gene Name: chromosome 1 open reading frame 194
  Uniprot ID: Q5T5A4
  ENSP ID: ENSP00000358965
MERSPSRRRRLEEAPKLPYKNPTHLAQQQEPWSRLNSTPTITSMRRDAYYFDPEIPKDDLDFRLAALYNHHTGTFKNKSEILLNQKTTQDTYRTKIQFPGEFLTPPTPPITFLANIRHWINPKKESIHSIQGSIVSPHTAATNGGYSRKKDGGFFST

SEQ ID NO: 15424 - protein, 36 aa, Homo sapiens
  Payload ID: 3040
  Gene Symbol: C1orf194
  Gene Name: chromosome 1 open reading frame 194
  ENSP ID: ENSP00000435090
MERSPSRRRRLEEAPNQDPIPWRIFNPSHSTHHFPG

SEQ ID NO: 15425 - protein, 48 aa, Homo sapiens
  Payload ID: 3040
  Gene Symbol: C1orf194
  Gene Name: chromosome 1 open reading frame 194
  ENSP ID: ENSP00000435947
MPPTRDPFQQPTLDNDDSYLGELRASKNQDPIPWRIFNPSHSTHHFPG

SEQ ID NO: 15426 - protein, 327 aa, Homo sapiens
  Payload ID: 3041
  Gene Symbol: C1orf198
  Gene Name: chromosome 1 open reading frame 198
  Uniprot ID: Q9H425
  ENSP ID: ENSP00000355623
MASMAAAIAASRSAVMSGNRPLDDRERKRFTYFSSLSPMARKIMQDKEKIREKYGPEWARLPPAQQDEIIDRCLVGPRAPAPRDPGDSEELTRFPGLRGPTGQKVVRFGDEDLTWQDEHSAPFSWETKSQMEFSISALSIQEPSNGTAASEPRPLSKASQGSQALKSSQGSRSSSLDALGPTRKEEEASFWKINAERSRGEGPEAEFQSLTPSQIKSMEKGEKVLPPCYRQEPAPKDREAKVERPSTLRQEQRPLPNVSTERERPQPVQAFSSALHEAAPSQLEGKLPSPDVRQDDGEDTLFSEPKFAQVSSSNVVLKTGFDFLDNW

SEQ ID NO: 15427 - protein, 110 aa, Homo sapiens
  Payload ID: 3041
  Gene Symbol: C1orf198
  Gene Name: chromosome 1 open reading frame 198
  ENSP ID: ENSP00000411384
MEKGEKVLPPCYRQEPAPKDREAKVERPSTLRQEQRPLPNVSTERERPQPVQAFSSALHEAAPSQLEGKLPSPDVRQDDGEDTLFSEPKFAQVSSSNVVLKTGFDFLDNW

SEQ ID NO: 15428 - protein, 289 aa, Homo sapiens
  Payload ID: 3041
  Gene Symbol: C1orf198
  Gene Name: chromosome 1 open reading frame 198
  Uniprot ID: Q9H425
  ENSP ID: ENSP00000428172
MARKIMQDKEKIREKYGPEWARLPPAQQDEIIDRCLVGPRAPAPRDPGDSEELTRFPGLRGPTGQKVVRFGDEDLTWQDEHSAPFSWETKSQMEFSISALSIQEPSNGTAASEPRPLSKASQGSQALKSSQGSRSSSLDALGPTRKEEEASFWKINAERSRGEGPEAEFQSLTPSQIKSMEKGEKVLPPCYRQEPAPKDREAKVERPSTLRQEQRPLPNVSTERERPQPVQAFSSALHEAAPSQLEGKLPSPDVRQDDGEDTLFSEPKFAQVSSSNVVLKTGFDFLDNW

SEQ ID NO: 15429 - protein, 160 aa, Homo sapiens
  Payload ID: 3041
  Gene Symbol: C1orf198
  Gene Name: chromosome 1 open reading frame 198
  ENSP ID: ENSP00000429503
MQDKEKIREKYGPEWARLPPAQQDEIIDRCLVGPRAPAPRDPGDSEELTRFPGLRGPTGQKVVRFGDEDLTWQDEHSAPFSWETKSQMEFSISALSIQEPSNGTAASEPRPLSKASQGSQALKSSQGSRSSSLDALGPTRKEEEASFWKINAERSRGEGP

SEQ ID NO: 15430 - protein, 197 aa, Homo sapiens
  Payload ID: 3041
  Gene Symbol: C1orf198
  Gene Name: chromosome 1 open reading frame 198
  Uniprot ID: Q9H425
  ENSP ID: ENSP00000430967
MEFSISALSIQEPSNGTAASEPRPLSKASQGSQALKSSQGSRSSSLDALGPTRKEEEASFWKINAERSRGEGPEAEFQSLTPSQIKSMEKGEKVLPPCYRQEPAPKDREAKVERPSTLRQEQRPLPNVSTERERPQPVQAFSSALHEAAPSQLEGKLPSPDVRQDDGEDTLFSEPKFAQVSSSNVVLKTGFDFLDNW

SEQ ID NO: 15431 - protein, 235 aa, Homo sapiens
  Payload ID: 3042
  Gene Symbol: C1orf204
  Gene Name: chromosome 1 open reading frame 204
  Uniprot ID: Q5VU13
  ENSP ID: ENSP00000357082
MGMLAPGPLQGRRPRKGHKGQEDAVAPGCKASGRGSRVTHLLGYPTQNVSRSLRRKYAPPPCGGPEDVALAPCTAAAACEAGPSPVYVKVKSAEPADCAEGPVQCKNGLLVSSPHCEEPCAHSCAHPGLPPHLVHKLPLSYLQTQDTDAASRRINAPLAAGWSWLRLWLVTLASGVDFPQVSAWMRALPSPDCPGLRTTGEQMQKLLLKENKVKTRKSKRRSGEGSHLTTSILEQ

SEQ ID NO: 15432 - protein, 235 aa, Homo sapiens; identical to SEQ ID NO: 15431
  Payload ID: 3042
  Gene Symbol: C1orf204
  Gene Name: chromosome 1 open reading frame 204
  Uniprot ID: Q5VU13
  ENSP ID: ENSP00000480481

SEQ ID NO: 15433 - protein, 121 aa, Homo sapiens
  Payload ID: 3043
  Gene Symbol: C1orf21
  Gene Name: chromosome 1 open reading frame 21
  Uniprot ID: Q9H246
  ENSP ID: ENSP00000235307
MGCASAKHVATVQNEEEAQKGKNYQNGDVFGDEYRIKPVEEVKYMKNGAEEEQKIAARNQENLEKSASSNVRLKTNKEVPGLVHQPRANMHISESQQEFFRMLDEKIEKGRDYCSEEEDIT

SEQ ID NO: 15434 - protein, 113 aa, Homo sapiens
  Payload ID: 3044
  Gene Symbol: C1orf210
  Gene Name: chromosome 1 open reading frame 210
  Uniprot ID: Q8IVY1
  ENSP ID: ENSP00000429399
MNETNKTLVGPSELPTASAVAPGPGTGARAWPVLVGFVLGAVVLSLLIALAAKCHLCRRYHASYRHRPLPETGRGGRPQVAEDEDDDGFIEDNYIQPGTGELGTEGSRDHFSL

SEQ ID NO: 15435 - protein, 113 aa, Homo sapiens; identical to SEQ ID NO: 15434
  Payload ID: 3044
  Gene Symbol: C1orf210
  Gene Name: chromosome 1 open reading frame 210
  Uniprot ID: Q8IVY1
  ENSP ID: ENSP00000430918

SEQ ID NO: 15436 - protein, 229 aa, Homo sapiens
  Payload ID: 3045
  Gene Symbol: C1orf216
  Gene Name: chromosome 1 open reading frame 216
  Uniprot ID: Q8TAB5
  ENSP ID: ENSP00000425166
MFAIQPGLAEGGQFLGDPPPGLCQPELQPDSNSNFMASAKDANENWHGMPGRVEPILRRSSSESPSDNQAFQAPGSPEEGVRSPPEGAEIPGAEPEKMGGAGTVCSPLEDNGYASSSLSIDSRSSSPEPACGTPRGPGPPDPLLPSVAQAVQHLQVQERYKEQEKEKHHVHLVMYRRLALLQWIRGLQHQLIDQQARLQESFDTILDNRKELIRCLQQRAAPSRPQDQA

SEQ ID NO: 15437 - protein, 171 aa, Homo sapiens
  Payload ID: 3046
  Gene Symbol: C1orf226
  Gene Name: chromosome 1 open reading frame 226
  ENSP ID: ENSP00000398035
MFENLNTALTPKLQASRSFPHLSKPVAPGSAPLGSGEPGGPGLWVGSSQHLKNLGKAMGAKVNDFLRRKEPSSLGSVGVTEINKTAGAQLASGTDAAPEAWLEDERSVLQETFPRLDPPPPITRKRTPRALKTTQDMLISSQPVLSSLEYGTEPSPGQAQDSAPTAQPDVP

SEQ ID NO: 15438 - protein, 315 aa, Homo sapiens
  Payload ID: 3046
  Gene Symbol: C1orf226
  Gene Name: chromosome 1 open reading frame 226
  Uniprot ID: A1L170
  ENSP ID: ENSP00000413150
MLVLVAQAGGDTLKVTGHYVKCVFLLFVSHLLSEPLSRTVDHGMFENLNTALTPKLQASRSFPHLSKPVAPGSAPLGSGEPGGPGLWVGSSQHLKNLGKAMGAKVNDFLRRKEPSSLGSVGVTEINKTAGAQLASGTDAAPEAWLEDERSVLQETFPRLDPPPPITRKRTPRALKTTQDMLISSQPVLSSLEYGTEPSPGQAQDSAPTAQPDVPADASQPEATMEREERGKVLPNGEVSLSVPDLIHKDSQDESKLKMTECRRASSPSLIERNGFKLSLSPISLAESWEDGSPPPQARTSSLDNEGPHPDLLSFE

SEQ ID NO: 15439 - protein, 272 aa, Homo sapiens
  Payload ID: 3046
  Gene Symbol: C1orf226
  Gene Name: chromosome 1 open reading frame 226
  Uniprot ID: A1L170
  ENSP ID: ENSP00000437071
MFENLNTALTPKLQASRSFPHLSKPVAPGSAPLGSGEPGGPGLWVGSSQHLKNLGKAMGAKVNDFLRRKEPSSLGSVGVTEINKTAGAQLASGTDAAPEAWLEDERSVLQETFPRLDPPPPITRKRTPRALKTTQDMLISSQPVLSSLEYGTEPSPGQAQDSAPTAQPDVPADASQPEATMEREERGKVLPNGEVSLSVPDLIHKDSQDESKLKMTECRRASSPSLIERNGFKLSLSPISLAESWEDGSPPPQARTSSLDNEGPHPDLLSFE

SEQ ID NO: 15440 - protein, 115 aa, Homo sapiens
  Payload ID: 3047
  Gene Symbol: C1orf228
  Gene Name: chromosome 1 open reading frame 228
  ENSP ID: ENSP00000417206
MTSIKEQAAISRLLSFLQEWDNAGKVARSHILDKFIETNQGKTAPELEQEFSQGASLFLVRLTTSLRITYMTDSCLEKLLRSIGIFLSAVSSNRYLIEFLEVGGVLTLLEILGLE

SEQ ID NO: 15441 - protein, 81 aa, Homo sapiens
  Payload ID: 3047
  Gene Symbol: C1orf228
  Gene Name: chromosome 1 open reading frame 228
  ENSP ID: ENSP00000417538
MTSIKEQAAISRLLSFLQEWDNAGKVARSHILDKFIETNQGKTAPELEQEFSQGASLFLVRLTTSLRITYMTDSCLEKLLR

SEQ ID NO: 15442 - protein, 209 aa, Homo sapiens
  Payload ID: 3047
  Gene Symbol: C1orf228
  Gene Name: chromosome 1 open reading frame 228
  ENSP ID: ENSP00000417998
MTSIKEQAAISRLLSFLQEWDNAGKVARSHILDKFIETNQGKTAPELEQEFSQGASLFLVRLTTSLRITYMTDSCLEKLLRSIGIFLSAVSSNRYLIEFLEVGGVLTLLEILGLEKIKEEAKKESVKLLQVIANSGRTYKELICESYGVRSIAEFLAKSKSEETQEEVQVLLDSLVHGNPKYQNQVYKGLIALLPCESPKAQQLSLQTL

SEQ ID NO: 15443 - protein, 164 aa, Homo sapiens
  Payload ID: 3047
  Gene Symbol: C1orf228
  Gene Name: chromosome 1 open reading frame 228
  ENSP ID: ENSP00000420050
  MOD_RES (1)..(1): Any amino acid
XTGAGVFPGSQFVPGVRSIAEFLAKSKSEETQEEVQVLLDSLVHGNPKYQNQVYKGLIALLPCESPKAQQLSLQTLRTAQPIIGTTHPSIVDCVLKVLGTMHLEVQYEAIELIKDLVGYDVRQALLKGLVALLIPSVKEISKLQAKILSAHPQPADVFAAGRGR

SEQ ID NO: 15444 - protein, 59 aa, Homo sapiens
  Payload ID: 3047
  Gene Symbol: C1orf228
  Gene Name: chromosome 1 open reading frame 228
  ENSP ID: ENSP00000420358
MTSIKEQAAISRLLSFLQEWDNAGKVARSHILDKFIETNQGKTAPELEQEFSQGASLFL

SEQ ID NO: 15445 - protein, 220 aa, Homo sapiens
  Payload ID: 3047
  Gene Symbol: C1orf228
  Gene Name: chromosome 1 open reading frame 228
  ENSP ID: ENSP00000420664
MTSIKEQAAISRLLSFLQEWDNAGKVARSHILDKFIETNQGKTAPELEQEFSQGASLFLVRLTTSLRITYMTDSCLEKLLRSIGIFLSAVSSNRYLIEFLEVGGVLTLLEILGLEKIKEEAKKESVKLLQVIANSGRTYKELICESYGVRSIAEFLAKSKSEETQEEVQVLLDSLVHGNPKYQNQVYKGLIALLPCESPKAQQLSLQTLRTAQPIIGTTH

SEQ ID NO: 15446 - protein, 440 aa, Homo sapiens
  Payload ID: 3047
  Gene Symbol: C1orf228
  Gene Name: chromosome 1 open reading frame 228
  Uniprot ID: Q6PIY5
  ENSP ID: ENSP00000420716
MTSIKEQAAISRLLSFLQEWDNAGKVARSHILDKFIETNQGKTAPELEQEFSQGASLFLVRLTTSLRITYMTDSCLEKLLRSIGIFLSAVSSNRYLIEFLEVGGVLTLLEILGLEKIKEEAKKESVKLLQVIANSGRTYKELICESYGVRSIAEFLAKSKSEETQEEVQVLLDSLVHGNPKYQNQVYKGLIALLPCESPKAQQLSLQTLRTAQPIIGTTHPSIVDCVLKVLGTMHLEVQYEAIELIKDLVGYDVRQALLKGLVALLIPSVKEISKLQAKILSDPSVLQLTPSLPMFLQQAAAAKAIGVLARNDMSIAEELLYLRVVRGLMAAMGNTDHSNSQRLASLTLECFVQMFPLVAEHVRKCMGEELYQLFLSNAEDLYMKIDSIQADILAANTVNVTKALCLHGSSYSMNTLYGSRDSAQMAYLTHFEEDVESKE

SEQ ID NO: 15447 - protein, 440 aa, Homo sapiens; identical to SEQ ID NO: 15446
  Payload ID: 3047
  Gene Symbol: C1orf228
  Gene Name: chromosome 1 open reading frame 228
  Uniprot ID: Q6PIY5
  ENSP ID: ENSP00000440524

SEQ ID NO: 15448 - protein, 226 aa, Homo sapiens
  Payload ID: 3048
  Gene Symbol: C1orf233
  Gene Name: chromosome 1 open reading frame 233
  Uniprot ID: F2Z333
  ENSP ID: ENSP00000389111
MRAPPLLLLLAACAPPPCAAAAPTPPGWEPTPDAPWCPYKVLPEGPEAGGGRLCFRSPARGFRCQAPGCVLHAPAGRSLRASVLRNRSVLLQWRLAPAAARRVRAFALNCSWRGAYTRFPCERVLLGASCRDYLLPDVHDSVLYRLCLQPLPLRAGPAAAAPETPEPAECVEFTAEPAGMQDIVVAMTAVGGSICVMLVVICLLVAYITENLMRPALARPGLRRHP

SEQ ID NO: 15449 - protein, 121 aa, Homo sapiens
  Payload ID: 3049
  Gene Symbol: C1orf234
  Gene Name: chromosome 1 open reading frame 234
  Uniprot ID: H3BTG2
  ENSP ID: ENSP00000457161
MSLHGILASAGTIGAVAAWLMSYKPALFGFLFLLLLLSNWLVKYEHKLTLPEPQQDEILQRLLFSEMKMKVLENQMFIIWNKMNHHGRSSRHRNFPMKKHRMRRHESICPTLSDCTSSSPS

SEQ ID NO: 15450 - protein, 121 aa, Homo sapiens
  Payload ID: 3049
  Gene Symbol: C1orf234
  Gene Name: chromosome 1 open reading frame 234
  ENSP ID: ENSP00000487118
RSLHGILASAGTIGAVAAWLMSYKPALFGFLFLLLLLSNWLVKYEHKLTLPEPQQDEILQRLLFSEMKMKVLENQMFIIWNKMNHHGRSSRHRNFPMKKHRMRRHESICPTLSDCTSSSPS

SEQ ID NO: 15451 - protein, 147 aa, Homo sapiens
  Payload ID: 3049
  Gene Symbol: C1orf234
  Gene Name: chromosome 1 open reading frame 234
  ENSP ID: ENSP00000487236
  MOD_RES (1)..(1): Any amino acid
XSAGTIGAVAAWLMSYKPALFGFLFLLLLLSNWLVKYEHKLTLPEPQQEEEKPKTSENDSKNSKAVNTKEVNRTHACFALQDEILQRLLFSEMKMKVLENQMFIIWNKMNHHGRSSRHRNFPMKKHRMRRHESICPTLSDCTSSSPS

SEQ ID NO: 15452 - protein, 454 aa, Homo sapiens
  Payload ID: 3050
  Gene Symbol: C1orf27
  Gene Name: chromosome 1 open reading frame 27
  Uniprot ID: Q5SWX8
  ENSP ID: ENSP00000287859
MGRTYIVEETVGQYLSNINLQGKAFVSGLLIGQCSSQKDYVILATRTPPKEEQSENLKHPKAKLDNLDEEWATEHACQVSRMLPGGLLVLGVFIITTLELANDFQNALRRLMFAVEKSINRKRLWNFTEEEVSERVTLHICASTKKIFCRTYDIHDPKSSARPADWKYQSGLSSSWLSLECTVHINIHIPLSATSVSYTLEKNTKNGLTRWAKEIENGVYLINGQVKDEDCDLLEGQKKSSRGNTQATSHSFDVRVLTQLLLNSDHRSTATVQICSGSVNLKGAVKCRAYIHSSKPKVKDAVQAVKRDILNTVADRCEMLFEDLLLNEIPEKKDSEKEFHVLPYRVFVPLPGSTVMLCDYKFDDESAEEIRDHFMEMLDHTIQIEDLEIAEETNTACMSSSMNSQASLDNTDDEQPKQPIKTTMLLKIQQNIGVIAAFTVAVLAAGISFHYFSD

SEQ ID NO: 15453 - protein, 431 aa, Homo sapiens
  Payload ID: 3050
  Gene Symbol: C1orf27
  Gene Name: chromosome 1 open reading frame 27
  Uniprot ID: Q5SWX8
  ENSP ID: ENSP00000356440
MGRTYIVEETVGQYLSNINLQGKAFVSGLLIGQCSSQKDYVILATRTPPKEEQSENLKHPKAKLDNLDEEWATEHACQVSRMLPGGLLVLGVFIITTLELANDFQNALRRLMFAVEKSINRKRLWNFTEEEVSERVTLHICASTKKIFCRTYDIHDPKSSARPADWKYQSGLSSSWLSLECTVHINIHIPLSATSVSYTLEKNTKNGLTRWAKEIENGVYLINGQVKDEDCDLLEGQLLNSDHRSTATVQICSGSVNLKGAVKCRAYIHSSKPKVKDAVQAVKRDILNTVADRCEMLFEDLLLNEIPEKKDSEKEFHVLPYRVFVPLPGSTVMLCDYKFDDESAEEIRDHFMEMLDHTIQIEDLEIAEETNTACMSSSMNSQASLDNTDDEQPKQPIKTTMLLKIQQNIGVIAAFTVAVLAAGISFHYFSD

SEQ ID NO: 15454 - protein, 422 aa, Homo sapiens
  Payload ID: 3050
  Gene Symbol: C1orf27
  Gene Name: chromosome 1 open reading frame 27
  Uniprot ID: Q5SWX8
  ENSP ID: ENSP00000395084
MGRTYIVEETVGQYLSNINLQGKAFVSGLLIGQCSSQKDYVILATRTPPKEEQSENLKHPKAKLDNLDEEWATEHACQLMFAVEKSINRKRLWNFTEEEVSERVTLHICASTKKIFCRTYDIHDPKSSARPADWKYQSGLSSSWLSLECTVHINIHIPLSATSVSYTLEKNTKNGLTRWAKEIENGVYLINGQVKDEDCDLLEGQKKSSRGNTQATSHSFDVRVLTQLLLNSDHRSTATVQICSGSVNLKGAVKCRAYIHSSKPKVKDAVQAVKRDILNTVADRCEMLFEDLLLNEIPEKKDSEKEFHVLPYRVFVPLPGSTVMLCDYKFDDESAEEIRDHFMEMLDHTIQIEDLEIAEETNTACMSSSMNSQASLDNTDDEQPKQPIKTTMLLKIQQNIGVIAAFTVAVLAAGISFHYFSD

SEQ ID NO: 15455 - protein, 263 aa, Homo sapiens
  Payload ID: 3051
  Gene Symbol: C1orf35
  Gene Name: chromosome 1 open reading frame 35
  Uniprot ID: Q9BU76
  ENSP ID: ENSP00000272139
MFGSSRGGVRGGQDQFNWEDVKTDKQRENYLGNSLMAPVGRWQKGRDLTWYAKGRAPCAGPSREEELAAVREAEREALLAALGYKNVKKQPTGLSKEDFAEVCKREGGDPEEKGVDRLLGLGSASGSVGRVAMSREDKEAAKLGLSVFTHHRVESGGPGTSAASARRKPRAEDQTESSCESHRKSKKEKKKKKKRKHKKEKKKKDKEHRRPAEATSSPTSPERPRHHHHDSDSNSPCCKRRKRGHSGDRRSPSRRWHDRGSEA

SEQ ID NO: 15456 - protein, 219 aa, Homo sapiens
  Payload ID: 3052
  Gene Symbol: C1orf43
  Gene Name: chromosome 1 open reading frame 43
  Uniprot ID: Q9BWL3
  ENSP ID: ENSP00000271925
MASGSNWLSGVNVVLVMAYGSLDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 15457 - protein, 201 aa, Homo sapiens
  Payload ID: 3052
  Gene Symbol: C1orf43
  Gene Name: chromosome 1 open reading frame 43
  Uniprot ID: Q9BWL3
  ENSP ID: ENSP00000354496
MASGSNWLSGVNVVLVMAYGSLDLKEEIDIRLSRVQDIKYEPQLLADDDARLLQLETQGNQKIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 15458 - protein, 155 aa, Homo sapiens
  Payload ID: 3052
  Gene Symbol: C1orf43
  Gene Name: chromosome 1 open reading frame 43
  ENSP ID: ENSP00000357502
MASGSNWLSGVNVVLVMAYGSLDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATA

SEQ ID NO: 15459 - protein, 189 aa, Homo sapiens
  Payload ID: 3052
  Gene Symbol: C1orf43
  Gene Name: chromosome 1 open reading frame 43
  Uniprot ID: Q9BWL3
  ENSP ID: ENSP00000357504
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATA

SEQ ID NO: 15460 - protein, 235 aa, Homo sapiens
  Payload ID: 3052
  Gene Symbol: C1orf43
  Gene Name: chromosome 1 open reading frame 43
  ENSP ID: ENSP00000357505
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQKIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 15461 - protein, 253 aa, Homo sapiens
  Payload ID: 3052
  Gene Symbol: C1orf43
  Gene Name: chromosome 1 open reading frame 43
  Uniprot ID: Q9BWL3
  ENSP ID: ENSP00000357507
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 15462 - protein, 199 aa, Homo sapiens
  Payload ID: 3053
  Gene Symbol: C1orf50
  Gene Name: chromosome 1 open reading frame 50
  Uniprot ID: Q9BV19
  ENSP ID: ENSP00000361603
MEDAAAPGRTEGVLERQGAPPAAGQGGALVELTPTPGGLALVSPYHTHRAGDPLDLVALAEQVQKADEFIRANATNKLTVIAEQIQHLQEQARKVLEDAHRDANLHHVACNIVKKPGNIYYLYKRESGQQYFSIISPKEWGTSCPHDFLGAYKLQHDLSWTPYEDIEKQDAKISMMDTLLSQSVALPPCTEPNFQGLTH

SEQ ID NO: 15463 - protein, 42 aa, Homo sapiens
  Payload ID: 3053
  Gene Symbol: C1orf50
  Gene Name: chromosome 1 open reading frame 50
  ENSP ID: ENSP00000473339
MEDAAAPGRTEGVLERQGAPPAAGQGGTGRCSQRCQPAPCSL

SEQ ID NO: 15464 - protein, 109 aa, Homo sapiens
  Payload ID: 3053
  Gene Symbol: C1orf50
  Gene Name: chromosome 1 open reading frame 50
  ENSP ID: ENSP00000473874
MEDAAAPGRTEGVLERQGAPPAAGQGGMRGGSQQGEVSSREAAGLGAPREADGGSSRLVFLGVCRRSPGGAHPDPRRPGPGEPLPHPPGRGPLRPRGARRAGAEVFSHL

SEQ ID NO: 15465 - protein, 167 aa, Homo sapiens
  Payload ID: 3054
  Gene Symbol: C1orf52
  Gene Name: chromosome 1 open reading frame 52
  Uniprot ID: Q8N6N3
  ENSP ID: ENSP00000345092
MAAEEKDPLSYFAAYGSSSSGSSDEEDNIEPEETSRRTPDPAKSAGGCRNKAEKRLPGPDELFRSVTRPAFLYNPLNKQIDWERHVVKAPEEPPKEFKIWKSNYVPPPETYTTEKKPPPPELDMAIKWSNIYEDNGDDAPQNAKKARLLPEGEETLESALEDLEIQN

SEQ ID NO: 15466 - protein, 182 aa, Homo sapiens
  Payload ID: 3054
  Gene Symbol: C1orf52
  Gene Name: chromosome 1 open reading frame 52
  Uniprot ID: Q8N6N3
  ENSP ID: ENSP00000419417
MAAEEKDPLSYFAAYGSSSSGSSDEEDNIEPEETSRRTPDPAKSAGGCRNKAEKRLPGPDELFRSVTRPAFLYNPLNKQIDWERHVVKAPEEPPKEFKIWKSNYVPPPETYTTEKKPPPPELDMAIKWSNIYEDNGDDAPQNAKKARLLPEGEETLESDDEKDEHTSKKRKVEPGEPAKKKK

SEQ ID NO: 15467 - protein, 145 aa, Homo sapiens
  Payload ID: 3055
  Gene Symbol: C1orf53
  Gene Name: chromosome 1 open reading frame 53
  Uniprot ID: Q5VUE5
  ENSP ID: ENSP00000356363
MAARQIWARTGAALCRQPSAAPPPAPLWVRAGFRQQLSLTLCPANEGNCGGSAPSTPGRPERAARPSVSEELTAAERQIAELHAAACAAGQLNYVDPATGYVVLTQIAHLQRGECCGSACRHCPYGQVNVKDPSKKKQFNSYFYV

SEQ ID NO: 15468 - protein, 82 aa, Homo sapiens
  Payload ID: 3055
  Gene Symbol: C1orf53
  Gene Name: chromosome 1 open reading frame 53
  ENSP ID: ENSP00000396800
  MOD_RES (1)..(1): Any amino acid
XANEGNCGGSAPSTPGRPERAARPSAGQLNYVDPATGYVVLTQIAHLQRGECCGSACRHCPYGQVNVKDPSKKKQFNSYFYV

SEQ ID NO: 15469 - protein, 121 aa, Homo sapiens
  Payload ID: 3056
  Gene Symbol: C1orf54
  Gene Name: chromosome 1 open reading frame 54
  ENSP ID: ENSP00000358094
MDVLFVAIFAVPLILGQEYEDEERLGEDEYYQVVYYYTVTPSYDDFSADFTIDYSIFESEDRLNRLDKDITEAIETTISLETARADHPKPVTVKPVTTEPVEEGCYDSLDGSLARGNWKIK

SEQ ID NO: 15470 - protein, 131 aa, Homo sapiens
  Payload ID: 3056
  Gene Symbol: C1orf54
  Gene Name: chromosome 1 open reading frame 54
  Uniprot ID: Q8WWF1
  ENSP ID: ENSP00000358095
MDVLFVAIFAVPLILGQEYEDEERLGEDEYYQVVYYYTVTPSYDDFSADFTIDYSIFESEDRLNRLDKDITEAIETTISLETARADHPKPVTVKPVTTEPSPDLNDAVSSLRSPIPLLLSCAFVQVGMYFM

SEQ ID NO: 15471 - protein, 131 aa, Homo sapiens; identical to SEQ ID NO: 15470
  Payload ID: 3056
  Gene Symbol: C1orf54
  Gene Name: chromosome 1 open reading frame 54
  Uniprot ID: Q8WWF1
  ENSP ID: ENSP00000358098

SEQ ID NO: 15472 - protein, 341 aa, Homo sapiens
  Payload ID: 3057
  Gene Symbol: C1orf56
  Gene Name: chromosome 1 open reading frame 56
  Uniprot ID: Q9BUN1
  ENSP ID: ENSP00000357922
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTAMPSPEDLRLVLMPWGPWHCHCKSGTMSRSRSGKLHGLSGRLRVGALSQLRTEHKPCTYQQCPCNRLREECPLDTSLCTDTNCASQSTTSTRTTTTPFPTIHLRSSPSLPPASPCPALAFWKRVRIGLEDIWNSLSSVFTEMQPIDRNQR

SEQ ID NO: 15473 - protein, 140 aa, Homo sapiens
  Payload ID: 3058
  Gene Symbol: C1orf61
  Gene Name: chromosome 1 open reading frame 61
  ENSP ID: ENSP00000310651
GPPEQSLLLTEAWSWASKKKQPHLFSGVIVGGHLWLLGFSPGAGGFCTTLPPSFLRVDDRATSSTTDSSRAPSSPRPPGSTSHCGISTRCTERCLCVLPLRTSQVPDVMAPQHDQEPKRRMYFIWLGWIPSDKPSQLTER

SEQ ID NO: 15474 - protein, 169 aa, Homo sapiens
  Payload ID: 3058
  Gene Symbol: C1orf61
  Gene Name: chromosome 1 open reading frame 61
  ENSP ID: ENSP00000350661
PPEQSLLLTEAWSWASKKKQPHLFSGVIVGGHLWLLGFSPGAGGFCTTLPPSFLRVDDRATSSTTDSSRAPSSPRPPGSTSHCGISTRCTERCLCVLPLRTSQVPDVMAPQHDQEKFHDLAYSCLGKSFSMSNQDLYGYSTSSLALGLAWLSWETKKKNVLHLVGLDSL

SEQ ID NO: 15475 - protein, 188 aa, Homo sapiens
  Payload ID: 3058
  Gene Symbol: C1orf61
  Gene Name: chromosome 1 open reading frame 61
  ENSP ID: ENSP00000357225
  MOD_RES (1)..(1): Any amino acid
XAQRGPGKAGLTGGRERLERGARAARTDQHQRIQEEERDLTGSGDISPPQHPSRHSFSPGAGGFCTTLPPSFLRVDDRATSSTTDSSRAPSSPRPPGSTSHCGISTRCTERCLCVLPLRTSQVPDVMAPQHDQEKFHDLAYSCLGKSFSMSNQDLYGYSTSSLALGLAWLSWETKKKNVLHLVGLDSL

SEQ ID NO: 15476 - protein, 156 aa, Homo sapiens
  Payload ID: 3058
  Gene Symbol: C1orf61
  Gene Name: chromosome 1 open reading frame 61
  Uniprot ID: Q13536
  ENSP ID: ENSP00000357226
MFLTEDLITFNLRNFLLFQLWESSFSPGAGGFCTTLPPSFLRVDDRATSSTTDSSRAPSSPRPPGSTSHCGISTRCTERCLCVLPLRTSQVPDVMAPQHDQEKFHDLAYSCLGKSFSMSNQDLYGYSTSSLALGLAWLSWETKKKNVLHLVGLDSL

SEQ ID NO: 15477 - protein, 66 aa, Homo sapiens
  Payload ID: 3058
  Gene Symbol: C1orf61
  Gene Name: chromosome 1 open reading frame 61
  ENSP ID: ENSP00000383776
  MOD_RES (1)..(1): Any amino acid
XQPQGPPEQSLLLTEAWSWASKKKQPHLFSGVIVGGHLWLLGPKRRMYFIWLGWIPSDKPSQLTER

SEQ ID NO: 15478 - protein, 156 aa, Homo sapiens; identical to SEQ ID NO: 15476
  Payload ID: 3058
  Gene Symbol: C1orf61
  Gene Name: chromosome 1 open reading frame 61
  Uniprot ID: Q13536
  ENSP ID: ENSP00000479346

SEQ ID NO: 15479 - protein, 169 aa, Homo sapiens
  Payload ID: 3059
  Gene Symbol: C1orf64
  Gene Name: chromosome 1 open reading frame 64
  Uniprot ID: Q8NEQ6
  ENSP ID: ENSP00000332162
MAPSEDPRDWRANLKGTIRETGLETSSGGKLAGHQKTVPTAHLTFVIDCTHGKQLSLAATASPPQAPSPNRGLVTPPMKTYIVFCGENWPHLTRVTPMGGGCLAQARATLPLCRGSVASASFPVSPLCPQEVPEAKGKPVKAAPVRSSTWGTVKDSLKALSSCVCGQAD

SEQ ID NO: 15480 - protein, 250 aa, Homo sapiens
  Payload ID: 3060
  Gene Symbol: C1orf68
  Gene Name: chromosome 1 open reading frame 68
  Uniprot ID: Q5T750
  ENSP ID: ENSP00000357764
MCDQQKQPQFPPSCVKGSGLGAGQGSNGASVKCPVPCQTQTVCVTGPAPCPTQTYVKYQVPCQTQTYVKCPAPCQRTYVKYPTPCQTYVKCPAPCQTTYVKCPTPCQTYVKCPAPCQMTYIKSPAPCQTQTCYVQGASPCQSYYVQAPASGSTSQYCVTDPCSAPCSTSYCCLAPRTFGVSPLRRWIQRPQNCNTGSSGCCENSGSSGCCGSGGCGCSCGCGSSGCCCLGIIPMRSRGPACCDHEDDCCC

SEQ ID NO: 15481 - protein, 269 aa, Homo sapiens
  Payload ID: 3061
  Gene Symbol: C1orf74
  Gene Name: chromosome 1 open reading frame 74
  Uniprot ID: Q96LT6
  ENSP ID: ENSP00000294811
MLLLDLMSSPSPQLLVAAAQQTLGMGKRRSPPQAICLHLAGEVLAVARGLKPAVLYDCNCAGASELQSYLEELKGLGFLTFGLHILEIGENSLIVSPEHVCQHLEQVLLGTIAFVDVSSCQRHPSVCSLDQLQDLKALVAEIITHLQGLQRDLSLAVSYSRLHSSDWNLCTVFGILLGYPVPYTFHLNQGDDNCLALTPLRVFTARISWLLGQPPILLYSFSVPESLFPGLRDILNTWEKDLRTRFRTQNDFADLSISSEIVTLPAVAL

SEQ ID NO: 15482 - protein, 546 aa, Homo sapiens
  Payload ID: 3062
  Gene Symbol: C1orf87
  Gene Name: chromosome 1 open reading frame 87
  Uniprot ID: Q8N0U7
  ENSP ID: ENSP00000360244
MSSAWKTPRGSDAMPEIMVKIIGSKHFQYLVEKPKIKENDSLKTETQTMHQKPMTDNARQMSRDTPVPINFTDQQTTDNPDDVKEKKHPENNQKSENNQKLLTGANSSRFLDGNIPSQANVHCSSVPTGDQSLSYVHGIPRRKLRDWSLEQMVRGSSDQPEDIGQSPSGTTNEDAFLLALVRRELKSRPLSSNLLEKLQKELKILDPISSGFLLQSQLSRLFLKHEVPLQLPTVKILCQRFSKRGSPEMVNYEKLLWFLNSAASDYPQQNKAAADLRKTESHGTHSQSTPPQHSSSQPEVNRSLLEILKMALRTTNGRLNIDNLNLSFRKEDRSFSGCLPLPKVRAICGKHGLYLTLSLLETLLNHQDLGYQNEIKWQNFVEMLTRASSDLLSDLPTGKNEKKAPAPPMEPEVPEMSQSKTEHMKTPEEELQPESSPAETSACKDPLKPLKIRPVSQPFVNPAVKNKAEECETWIDRFRKLENALYLCDLSNTGVLEKERARRLIHNYNLIYNLSLSPQKIDQALRRFRSGENMLLEPALRYLKEL

SEQ ID NO: 15483 - protein, 317 aa, Homo sapiens
  Payload ID: 3062
  Gene Symbol: C1orf87
  Gene Name: chromosome 1 open reading frame 87
  ENSP ID: ENSP00000389432
MSSAWKTPRGSDAMPEIMVKIIGSKHFQYLVEKPKIKENDSLKTETQTMHQKPMTDNARQMSRDTPVPINFTDQQTTDNPDDVKEKKHPENNQKSENNQKLLTGANSSRFLDGNVRAICGKHGLYLTLSLLETLLNHQDLGYQNEIKWQNFVEMLTRASSDLLSDLPTGKNEKKAPAPPMEPEVPEMSQSKTEHMKTPEEELQPESSPAETSACKDPLKPLKIRPVSQPFVNPAVKNKAEECETWIDRFRKLENALYLCDLSNTGVLEKERARRLIHNYNLIYNLSLSPQKIDQALRRFRSGENMLLEPALRYLKEL

SEQ ID NO: 15484 - protein, 408 aa, Homo sapiens
  Payload ID: 3063
  Gene Symbol: C1orf94
  Gene Name: chromosome 1 open reading frame 94
  Uniprot ID: Q6P1W5
  ENSP ID: ENSP00000362472
MPVISSRQDCDSATSTVTDILCAAEVKSSKGTEDRGRILGDSNLQVSKLLSQFPLKSTETSKVPDNKNVLDKTRVTKDFLQDNLFSGPGPKEPTGLSPFLLLPPRPPPARPDKLPELPAQKRQLPVFAKICSKPKADPAVERHHLMEWSPGTKEPKKGQGSLFLSQWPQSQKDACGEEGCCDAVGTASLTLPPKKPTCPAEKNLLYEFLGATKNPSGQPRLRNKVEVDGPELKFNAPVTVADKNNPKYTGNVFTPHFPTAMTSATLNQPLWLNLNYPPPPVFTNHSTFLQYQGLYPQQAARMPYQQALHPQLGCYSQQVMPYNPQQMGQQIFRSSYTPLLSYIPFVQPNYPYPQRTPPKMSANPRDPPLMAGDGPQYLFPQGYGFGSTSGGPLMHSPYFSSSGNGINF

SEQ ID NO: 15485 - protein, 598 aa, Homo sapiens
  Payload ID: 3063
  Gene Symbol: C1orf94
  Gene Name: chromosome 1 open reading frame 94
  Uniprot ID: Q6P1W5
  ENSP ID: ENSP00000435634
MRGGGGCVLALGGQRGFQKERRRMASGNGLPSSSALVAKGPCALGPFPRYIWIHQDTPQDSLDKTCHEIWKRVQGLPEASQPWTSMEQLSVPVVGTLRGNELSFQEEALELSSGKDEISLLVEQEFLSLTKEHSILVEESSGELEVPGSSPEGTRELAPCILAPPLVAGSNERPRASIIVGDKLLKQKVAMPVISSRQDCDSATSTVTDILCAAEVKSSKGTEDRGRILGDSNLQVSKLLSQFPLKSTETSKVPDNKNVLDKTRVTKDFLQDNLFSGPGPKEPTGLSPFLLLPPRPPPARPDKLPELPAQKRQLPVFAKICSKPKADPAVERHHLMEWSPGTKEPKKGQGSLFLSQWPQSQKDACGEEGCCDAVGTASLTLPPKKPTCPAEKNLLYEFLGATKNPSGQPRLRNKVEVDGPELKFNAPVTVADKNNPKYTGNVFTPHFPTAMTSATLNQPLWLNLNYPPPPVFTNHSTFLQYQGLYPQQAARMPYQQALHPQLGCYSQQVMPYNPQQMGQQIFRSSYTPLLSYIPFVQPNYPYPQRTPPKMSANPRDPPLMAGDGPQYLFPQGYGFGSTSGGPLMHSPYFSSSGNGINF

SEQ ID NO: 15486 - protein, 141 aa, Homo sapiens
  Payload ID: 3064
  Gene Symbol: C1orf95
  Gene Name: chromosome 1 open reading frame 95
  Uniprot ID: Q69YW2
  ENSP ID: ENSP00000355752
MEPSHKDAETAAAAAAVAAADPRGASSSSGVVVQVREKKGPLRAAIPYMPFPVAVICLFLNTFVPGLGTFVSAFTVLCGARTDLPDRHVCCVFWLNIAAALIQILTAIVMVGWIMSIFWGMDMVILAISQGYKEQGIPQQL

SEQ ID NO: 15487 - protein, 141 aa, Homo sapiens [sequence omitted]

SEQ ID NO: 15488 - protein, 212 aa, Homo sapiens
  Payload ID: 3065
  Gene Symbol: C10orf10
  Gene Name: chromosome 10 open reading frame 10
  Uniprot ID: Q9NTK1
  ENSP ID: ENSP00000298295
MRSRLLLSVAHLPTIRETTEEMLLGGPGQEPPPSPSLDDYVRSISRLAQPTSVLDKATAQGQPRPPHRPAQACRKGRPAVSLRDITARFSGQQPTLPMADTVDPLDWLFGESQEKQPSQRDLPRRTGPSAGLWGPHRQMDSSKPMGAPRGRLCEARMPGHSLARPPQDGQQSSDLRSWTFGQSAQAMASRHRPRPSSVLRTLYSHLPVIHEL

SEQ ID NO: 15489 - protein, 84 aa, Homo sapiens
  Payload ID: 3065
  Gene Symbol: C10orf10
  Gene Name: chromosome 10 open reading frame 10
  ENSP ID: ENSP00000414494
MRSRLLLSVAHLPTIRETTEEMLLGGPGQEPPPSPSLDDYVRSISRLAQPTSVLDKATAQGQPRPPHRPAQACRKGRPAVSLRD

SEQ ID NO: 15490 - protein, 133 aa, Homo sapiens
  Payload ID: 3066
  Gene Symbol: C10orf105
  Gene Name: chromosome 10 open reading frame 105
  Uniprot ID: Q8TEF2
  ENSP ID: ENSP00000381766
MSTEGPSLASSPAISPLAFLSAPVTPGTLAEATDPLPMLIALACIFLLLATCLLFMTLCKPAALDPSRRRAHECMPHHPGSPSEPQLRLWKRLGSLRLSLHSFRHGRPTVPRQPLPGPEDNRSHCDYMESTKM

SEQ ID NO: 15491 - protein, 133 aa, Homo sapiens; identical to SEQ ID NO: 15490
  Payload ID: 3066
  Gene Symbol: C10orf105
  Gene Name: chromosome 10 open reading frame 105
  Uniprot ID: Q8TEF2
  ENSP ID: ENSP00000403151

SEQ ID NO: 15492 - protein, 208 aa, Homo sapiens
  Payload ID: 3067
  Gene Symbol: C10orf107
  Gene Name: chromosome 10 open reading frame 107
  Uniprot ID: Q8IVU9
  ENSP ID: ENSP00000328698
MDFSIIQYSKFMTLLAMSLQNLKTLHMSLEESIKWLGEVMAEIGPTHSQKSEDWNIFDVKQANAIIDYLKISLFQHYKLYEFMFYSAREEIVIGTEQVIEVVKSACGPFPNPLEEGISFDIYSTFIEPPTILDTEMKRLDQEQGPEESQPETDTSDMDPLVGFTIEDVKSVLDQVTDDILIGIQTEINEKLQIQEEAFNARIEKLKKA

SEQ ID NO: 15493 - protein, 69 aa, Homo sapiens
  Payload ID: 3067
  Gene Symbol: C10orf107
  Gene Name: chromosome 10 open reading frame 107
  ENSP ID: ENSP00000374290
MSLEESIKWLGEVMAEIGPTHSQKSEDWNIFDVKQANAIIDYLKISLFQHYKLYEFMFYSAREEIVIGT

SEQ ID NO: 15494 - protein, 198 aa, Homo sapiens
  Payload ID: 3068
  Gene Symbol: C10orf11
  Gene Name: chromosome 10 open reading frame 11
  Uniprot ID: Q9H2I8
  ENSP ID: ENSP00000361577
MEKYLSLSGNHSSNKRSLEGLSAFRSLEELILDNNQLGDDLVLPGLPRLHTLTLNKNRITDLENLLDHLAEVTPALEYLSLLGNVACPNELVSLEKDEEDYKRYRCFVLYKLPNLKFLDAQKVTRQEREEALVRGVFMKVVKPKASSEDVASSPERHYTPLPSASRELTSHQGVLGKCRYVYYGKNSEGNRFIRDDQL

SEQ ID NO: 15495 - protein, 55 aa, Homo sapiens
  Payload ID: 3068
  Gene Symbol: C10orf11
  Gene Name: chromosome 10 open reading frame 11
  ENSP ID: ENSP00000472558
MASSEDVASSPERHYTPLPSASRELTSHQGVLGKCRYVYYGKNSEGNRFIRDDQL

SEQ ID NO: 15496 - protein, 226 aa, Homo sapiens
  Payload ID: 3068
  Gene Symbol: C10orf11
  Gene Name: chromosome 10 open reading frame 11
  ENSP ID: ENSP00000480240
MAGLVVRGTQVSYIGQDCREIPEHLGRDCGHFAKRLDLSFNLLRSLEGLSAFRSLEELILDNNQLGDDLVLPGLPRLHTLTLNKNRITDLENLLDHLAEVTPALEYLSLLGNVACPNELVSLEKDEEDYKRYRCFVLYKLPNLKFLDAQKVTRQEREEALVRGVFMKVVKPKASSEDVASSPERHYTPLPSASRELTSHQGVLGKCRYVYYGKNSEGNRFIRDDQL

SEQ ID NO: 15497 - protein, 131 aa, Homo sapiens [sequence omitted]

SEQ ID NO: 15498 - protein, 155 aa, Homo sapiens
  Payload ID: 3069
  Gene Symbol: C10orf113
  Gene Name: chromosome 10 open reading frame 113
  Uniprot ID: Q5VZT2
  ENSP ID: ENSP00000433646
MAKSERRIYSMESMAPEISEDIGCPLAYMRESVCALLINQSFFSCVAEMYIPDMNRPGKAERRAEKGLRPPRKLVGETRRLQSWPTLARWLRRVSFSLYKPPIQAAPEPDPGNWAKSPRLSLGPEGITKGKHGFKFQGIKEKFNVSKKVLKMTFL

SEQ ID NO: 15499 - protein, 79 aa, Homo sapiens
  Payload ID: 3069
  Gene Symbol: C10orf113
  Gene Name: chromosome 10 open reading frame 113
  Uniprot ID: Q5VZT2
  ENSP ID: ENSP00000434089
MAKSERRIYSMESMAPEISEDIGCPLAYMRESVCALLINQSFFSCVAEMYIPDMNRLEERTAALYPIGLVRQNGEPRRA

SEQ ID NO: 15500 - protein, 1247 aa, Homo sapiens
  Payload ID: 3070
  Gene Symbol: C10orf12
  Gene Name: chromosome 10 open reading frame 12
  Uniprot ID: Q8N655
  ENSP ID: ENSP00000286067
MQSSALVESLITVKMAAENSEEGNTCIIPQRNLFKALSEEAWNSGFMGNSSRTADKENTLQCPKTPLRQDLEANEQDARPKQENHLHSLGRNKVGYHLHPSDKGQFDHSKDGWLGPGPMPAVHKAANGHSRTKMISTSIKTARKSKRASGLRINDYDNQCDVVYISQPITECHFENQKSILSSRKTARKSTRGYFFNGDCCELPTVRTLARNLHSQEKASCSALASEAVFTPKQTLTIPAPRHTVDVQLPREDNPEEPSKEITSHEEGGGDVSPRKEPQEPEVCPTKIKPNLSSSPRSEETTASSLVWPLPAHLPEEDLPEGGSTVSAPTASGMSSPEHNQPPVALLDTEEMSVPQDCHLLPSTESFSGGVSEDVISRPHSPPEIVSREESPQCSENQSSPMGLEPPMSLGKAEDNQSISAEVESGDTQELNVDPLLKESSTFTDENPSETEESEAAGGIGKLEGEDGDVKCLSEKDTYDTSIDSLEENLDKKKKGKKFPEASDRCLRSQLSDSSSADRCLRNQSSDSSSACLEIKVPKNPSAKRSKKEGHPGGTTPKGLLPDSFHTETLEDTEKPSVNERPSEKDAEQEGEGGGIITRQTLKNMLDKEVKELRGEIFPSRDPITTAGQPLPGERLEIYVQSKMDEKNAHIPSESIACKRDPEQAKEEPGHIPTQHVEEAVNEVDNENTQQKDDESDAPCSSLGLSSSGSGDAARAPKSVPRPKRLTSSTYNLRHAHSLGSLDASKVTSEKEAAQVNPIMPKENGASESGDPLDEDDVDTVVDEQPKFMEWCAEEENQELIANFNAQYMKVQKGWIQLEKEGQPTPRARNKSDKLKEIWKSKKRSRKCRSSLESQKCSPVQMLFMTNFKLSNVCKWFLETTETRSLVIVKKLNTRLPGDVPPVKHPLQKYAPSSLYPSSLQAERLKKHLKKFPGATPAKNNWKMQKLWAKFRENPDQVEPEDGSDVSPGPNSEDSIEEVKEDRNSHPPANLPTPASTRILRKYSNIRGKLRAQQRLIKNEKMECPDALAVESKPSRKSVCINPLMSPKLALQVDADGFPVKPKSTEGMKGRKGKQVSEILPKAEVQSKRKRTEGSSPPDSKNKGPTVKASKEKHADGATKTPAAKRPAARDRSSQPPKKTSLKENKVKIPKKSAGKSCPPSRKEKENTNKRPSQSIASETLTKPAKQKGAGESSSRPQKATNRKQSSGKTRARPSTKTPESSAAQRKRKLKAKLDCSHSKRRRLDAK

SEQ ID NO: 15501 - protein, 335 aa, Homo sapiens
  Payload ID: 3071
  Gene Symbol: C10orf120
  Gene Name: chromosome 10 open reading frame 120
  Uniprot ID: Q5SQS8
  ENSP ID: ENSP00000331012
MIREWKNDCQRIEKQRASDTMVQERKNEKPVRIFNTNSSFQDQAPTCCQEDLSSASPLRIWSKFYRSDPRIALGKYSPLEKEILRLGGIHTIAARRLLAYKQEEECRMLKELQLLSPDYKQAMEYKKKHSSPCAICVPLEKIWTAKVIAPLEAFKMPQREQVNVSKHIERMRLARALGNHQPLPYIERFTRSSFLSGVGLGPMAKNKARRKEDNYDTHNCDDANQDKKEEAEGKNTKRREIKMNVVFKSKEPKKCLTYHGNDRKSFLPAKKPERSIAGLTNRNLFCISEFPGDLMLMNQDFISRRDHFSDLVKTYSLEEESIWKERMRKATPYHY

SEQ ID NO: 15502 - protein, 159 aa, Homo sapiens
  Payload ID: 3071
  Gene Symbol: C10orf120
  Gene Name: chromosome 10 open reading frame 120
  ENSP ID: ENSP00000410278
  MOD_RES (1)..(1): Any amino acid
XCQRIEKQRASDTMVQERKNEKPVRIFNTNSSFQDQAPTCCQEDLSSASPLRIWSKFYRSDPRIALGKYSPLEKEILRLGGIHTIAARRLLAYKQEEECRMLKELQLLSPDYKQAMEYKKKHSSPCAICVPLEKIWTAKVIAPLEAFKMPQREQNSLVT

SEQ ID NO: 15503 - protein, 159 aa, Homo sapiens
  Payload ID: 3072
  Gene Symbol: C10orf128
  Gene Name: chromosome 10 open reading frame 128
  Uniprot ID: Q5T292
  ENSP ID: ENSP00000363263
MNLGVSMLRILFLLDVGGAQVLATGKTPGAEIDFKYALIGTAVGVAISAGFLALKICMIRRHLFDDDSSDLKSTPGGLSDTIPLKKRAPRAHVLRDGPALGPLHLLFSVIGMLFARKLQASTLFSFKSLLQCHHCIMEGLFKAKPQFLQKVSCKSDHLS

SEQ ID NO: 15504 - protein, 140 aa, Homo sapiens
  Payload ID: 3072
  Gene Symbol: C10orf128
  Gene Name: chromosome 10 open reading frame 128
  ENSP ID: ENSP00000363266
MLRILFLLDVGGAQVLATGKTPGAEIDFKYALIGTAVGVAISAGFLALKICMIRRHLFDDDSSDLKSTPGGLSDTIPLKKRAPRKLQASTLFSFKSLLQCHHCIMEGLFKAKPQFLQKHLARSVQIHQLQKVKSFPKYAY

SEQ ID NO: 15505 - protein, 129 aa, Homo sapiens
  Payload ID: 3072
  Gene Symbol: C10orf128
  Gene Name: chromosome 10 open reading frame 128
  Uniprot ID: Q5T292
  ENSP ID: ENSP00000363268
MNLGVSMLRILFLLDVGGAQVLATGKTPGAEIDFKYALIGTAVGVAISAGFLALKICMIRRHLFDDDSSDLKSTPGGLSDTIPLKKRAPRKLQASTLFSFKSLLQCHHCIMEGLFKAKPQFLQKRCTGD

SEQ ID NO: 15506 - protein, 115 aa, Homo sapiens
  Payload ID: 3072
  Gene Symbol: C10orf128
  Gene Name: chromosome 10 open reading frame 128
  ENSP ID: ENSP00000395067
RILFLLDVGGAQVLATGKTPGAEIDFKYALIGTAVGVAISAGFLALKICMIRRHLFDDDSSDLKSTPGGLSGETTISPKASGQICANSPTTESEKFPKICLLTSRNDFSFCHQSG

SEQ ID NO: 15507 - protein, 105 aa, Homo sapiens
  Payload ID: 3072
  Gene Symbol: C10orf128
  Gene Name: chromosome 10 open reading frame 128
  Uniprot ID: Q5T292
  ENSP ID: ENSP00000417246
MNLGVSMLRILFLLDVGGAQVLATGKTPGAEIDFKYALIGTAVGVAISAGFLALKICMIRRHLFDDDSSDLKSTPGGLSDTIPLKKRAPRRNHNFSKRDAQVIEL

SEQ ID NO: 15508 - protein, 143 aa, Homo sapiens
  Payload ID: 3072
  Gene Symbol: C10orf128
  Gene Name: chromosome 10 open reading frame 128
  ENSP ID: ENSP00000432859
MGQVACHPKKRGQPLLRPRARAAWTTGVVQEGRMRDVGGAQVLATGKTPGAEIDFKYALIGTAVGVAISAGFLALKICMIRRHLFDDDSSDLKSTPGGLSGEGCGARAWLCPTQRGTEGHSVMLATARMNPQAQSPTGCKGRQ

SEQ ID NO: 15509 - protein, 176 aa, Homo sapiens
  Payload ID: 3073
  Gene Symbol: C10orf131
  Gene Name: chromosome 10 open reading frame 131
  Uniprot ID: A6NCD4
  ENSP ID: ENSP00000411850
MGVQMSEEMDNITAEEIIDKHLQKDLDAEENQNVAKTLRGKVREKLKISKINKGEKSSTEQLIDSEIHQRSKLSPQTEVSLDESLSFFILSGEEGSALGKSSEQRPVNRSYPKCFSLGVNLQNVAESEEEEFMKEFILTDILKVKAADYEDDQEQIKKQKANIFVPSSSPGNILSQ

SEQ ID NO: 15510 - protein, 61 aa, Homo sapiens
  Payload ID: 3073
  Gene Symbol: C10orf131
  Gene Name: chromosome 10 open reading frame 131
  ENSP ID: ENSP00000473537
MGVQMSEEMDNITAEEIIDKHLQKDLDAEENQNVAKTLRGKVREKLKISKINKGEKSSTEQ

SEQ ID NO: 15511 - protein, 176 aa, Homo sapiens [sequence omitted]

SEQ ID NO: 15512 - protein, 130 aa, Homo sapiens
  Payload ID: 3074
  Gene Symbol: C10orf142
  Gene Name: chromosome 10 open reading frame 142
  Uniprot ID: B7Z368
  ENSP ID: ENSP00000479444
MRMYSSDAHERPPSPSLGTTPPHPLPPTGSPRPRQDSAAGNSEEREPRGLRRASGVGSSCKRPTVCMGRQQGLPFCTVCGYRCSSPERTRGRCAVGKVRVAGGGGAPGGGAGMRCCGCRERNINKELELF

SEQ ID NO: 15513 - protein, 270 aa, Homo sapiens
  Payload ID: 3074
  Gene Symbol: C10orf142
  Gene Name: chromosome 10 open reading frame 142
  ENSP ID: ENSP00000488153
MRMYSSDAHERPPSPSLGTTPPHPLPPTGSPRPRQDSAAGNSEEREPRGLRRASGVGSCKRPTVCMGRQQGLPFCTVCGYRCSSPERTRGRCAVGKVRVAGGGGAPGGGAGMRCCGCRERSRGRNPSLPPNCEGAPRGGRAGSPGGRNRGAWSLRVAGSRGVLGGERPQPALPAHCEVAHRLCSRPSLSPGLQAVSIFARWILYGFIYSESGSTNEHSERKRVFGGVERFPSRCPPEGPLKGDLKPSFQLGHPFFFFLSFRNINKELELF

SEQ ID NO: 15514 - protein, 684 aa, Homo sapiens
  Payload ID: 3075
  Gene Symbol: C10orf2
  Gene Name: chromosome 10 open reading frame 2
  Uniprot ID: Q96RR1
  ENSP ID: ENSP00000309595
MWVLLRSGYPLRILLPLRGEWMGRRGLPRNLAPGPPRRRYRKETLQALDMPVLPVTATEIRQYLRGHGIPFQDGHSCLRALSPFAESSQLKGQTGVTTSFSLFIDKTTGHFLCMTSLAEGSWEDFQASVEGRGDGAREGFLLSKAPEFEDSEEVRRIWNRAIPLWELPDQEEVQLADTMFGLTKVTDDTLKRFSVRYLRPARSLVFPWFSPGGSGLRGLKLLEAKCQGDGVSYEETTIPRPSAYHNLFGLPLISRRDAEVVLTSRELDSLALNQSTGLPTLTLPRGTTCLPPALLPYLEQFRRIVFWLGDDLRSWEAAKLFARKLNPKRCFLVRPGDQQPRPLEALNGGFNLSRILRTALPAWHKSIVSFRQLREEVLGELSNVEQAAGLRWSRFPDLNRILKGHRKGELTVFTGPTGSGKTTFISEYALDLCSQGVNTLWGSFEISNVRLARVMLTQFAEGRLEDQLDKYDHWADRFEDLPLYFMTFHGQQSIRTVIDTMQHAVYVYDICHVIIDNLQFMMGHEQLSTDRIAAQDYIIGVFRKFATDNNCHVTLVIHPRKEDDDKELQTASIFGSAKASQEADNVLILQDRKLVTGPGKRYLQVSKNRFDGDVGVFPLEFNKNSLTFSIPPKNKARLKKIKDDTGPVAKKPSSGKKGATTQNSEICSGQAPTPDQPDTSKRSK

SEQ ID NO: 15515 - protein, 582 aa, Homo sapiens
  Payload ID: 3075
  Gene Symbol: C10orf2
  Gene Name: chromosome 10 open reading frame 2
  Uniprot ID: Q96RR1
  ENSP ID: ENSP00000359248
MWVLLRSGYPLRILLPLRGEWMGRRGLPRNLAPGPPRRRYRKETLQALDMPVLPVTATEIRQYLRGHGIPFQDGHSCLRALSPFAESSQLKGQTGVTTSFSLFIDKTTGHFLCMTSLAEGSWEDFQASVEGRGDGAREGFLLSKAPEFEDSEEVRRIWNRAIPLWELPDQEEVQLADTMFGLTKVTDDTLKRFSVRYLRPARSLVFPWFSPGGSGLRGLKLLEAKCQGDGVSYEETTIPRPSAYHNLFGLPLISRRDAEVVLTSRELDSLALNQSTGLPTLTLPRGTTCLPPALLPYLEQFRRIVFWLGDDLRSWEAAKLFARKLNPKRCFLVRPGDQQPRPLEALNGGFNLSRILRTALPAWHKSIVSFRQLREEVLGELSNVEQAAGLRWSRFPDLNRILKGHRKGELTVFTGPTGSGKTTFISEYALDLCSQGVNTLWGSFEISNVRLARVMLTQFAEGRLEDQLDKYDHWADRFEDLPLYFMTFHGQQSIRTVIDTMQHAVYVYDICHVIIDNLQFMMGHEQLSTDRIAAQDYIIGVFRKFATDNNCHVTLVIHPRKEDDDKELQTASIFGSAKVSGL

SEQ ID NO: 15516 - protein, 121 aa, Homo sapiens
  Payload ID: 3076
  Gene Symbol: C10orf35
  Gene Name: chromosome 10 open reading frame 35
  Uniprot ID: Q96D05
  ENSP ID: ENSP00000362376
MVRILANGEIVQDDDPRVRTTTQPPRGSIPRQSFFNRGHGAPPGGPGPRQQQAGARLGAAQSPFNDLNRQLVNMGFPQWHLGNHAVEPVTSILLLFLLMMLGVRGLLLVGLVYLVSHLSQR

SEQ ID NO: 15517 - protein, 103 aa, Homo sapiens
  Payload ID: 3076
  Gene Symbol: C10orf35
  Gene Name: chromosome 10 open reading frame 35
  ENSP ID: ENSP00000398621
MSPVLSGIHSIYSAWVTSVNITDCKPPSISGAAHQGPTAPGRMVRILANGEIVQDDDPRVRTTTQPPRGSIPRQSFFNRGHGAPPGGPGPRQQQAGARLGAAQ

SEQ ID NO: 15518 - protein, 93 aa, Homo sapiens
  Payload ID: 3077
  Gene Symbol: C10orf53
  Gene Name: chromosome 10 open reading frame 53
  Uniprot ID: Q8N6V4
  ENSP ID: ENSP00000363225
MPKNAVVILRYGPYSAAGLPVEHHTFRLQGLQAVLAIDGHEVILEKIEDWNVVELMVNEEVIFHCNIKDLEFGGDGKLDPLCEKARIAVLNAY

SEQ ID NO: 15519 - protein, 157 aa, Homo sapiens
  Payload ID: 3077
  Gene Symbol: C10orf53
  Gene Name: chromosome 10 open reading frame 53
  Uniprot ID: Q8N6V4
  ENSP ID: ENSP00000363226
MPKNAVVILRYGPYSAAGLPVEHHTFRLQGLQAVLAIDGHEVILEKIEDWNVVELMVNEEVIFHCNIKDLEFGKLTPSSDKRTTSSSRLTFHQLSSPCRMKVSPLQQFPQKTQDLTCTVLAQIGSCIHFQTNLCDLGWPGLDHMLISGLEKRGTQPY

SEQ ID NO: 15520 - protein, 93 aa, Homo sapiens
  Payload ID: 3077
  Gene Symbol: C10orf53
  Gene Name: chromosome 10 open reading frame 53
  Uniprot ID: Q8N6V4
  ENSP ID: ENSP00000363227
MPKNAVVILRYGPYSAAGLPVEHHTFRLQGLQAVLAIDGHEVILEKIEDWNVVELMVNEEVIFHCNIKDLEFGKPFGDASSQQFASSEESLNF

SEQ ID NO: 15521 - protein, 157 aa, Homo sapiens; identical to SEQ ID NO: 15519
  Payload ID: 3077
  Gene Symbol: C10orf53
  Gene Name: chromosome 10 open reading frame 53
  Uniprot ID: Q8N6V4
  ENSP ID: ENSP00000437726

SEQ ID NO: 15522 - protein, 311 aa, Homo sapiens
  Payload ID: 3078
  Gene Symbol: C10orf54
  Gene Name: chromosome 10 open reading frame 54
  Uniprot ID: Q9H7M9
  ENSP ID: ENSP00000378409
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 15523 - protein, 140 aa, Homo sapiens
  Payload ID: 3078
  Gene Symbol: C10orf54
  Gene Name: chromosome 10 open reading frame 54
  ENSP ID: ENSP00000473568
  MOD_RES (1)..(1): Any amino acid
XLPLPAPDHLPRISLALDDITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 15524 - protein, 151 aa, Homo sapiens
  Payload ID: 3079
  Gene Symbol: C10orf55
  Gene Name: chromosome 10 open reading frame 55
  Uniprot ID: Q5SWW7
  ENSP ID: ENSP00000409225
MFLHLDSHSSLERTKPTVVGVDTHMELDEVHCCPGRDSGGGFIKGPMLQGLQGEGKLAPIPKPTLPSPSRLTLFVSSSQMEDHGFPARRNGLTQASFIYQMPAGWGSPGGLFLPCQPVPTPVVLKPPLPPCPISWGESGPAVDGIRRTPAP

SEQ ID NO: 15525 - protein, 223 aa, Homo sapiens
  Payload ID: 3080
  Gene Symbol: C10orf62
  Gene Name: chromosome 10 open reading frame 62
  Uniprot ID: Q5T681
  ENSP ID: ENSP00000359674
MLWVQRKRRRKETSECPSDKDKSPESHKAKNESWIKSHFSRLSEEKLALDNNASASGNATQTESGSEEVSSTVHIETFTTRHGEVGSALHRESFTSRQKTSGPSVIQEIHQESGKAPSTDEATWAAVAACTKEIDTQGRHLAHSMLQRAIAYQHSGHLESKDINQEELRALEEVEMKLQKNFLTQRENTIAGANHTHTFYGHSHHSHHGHPSHQSHSLPNRRH

SEQ ID NO: 15526 - protein, 185 aa, Homo sapiens
  Payload ID: 3081
  Gene Symbol: C10orf67
  Gene Name: chromosome 10 open reading frame 67
  Uniprot ID: Q8IYJ2
  ENSP ID: ENSP00000321464
MMALVRDRRAHYVMSIVIRWVHCFSSSLRGTFGTRWEAMKAKATELRVCCARRKREAREFKPPQMRGSTRLNISDDLKIGFFSTDHATQTDSSEILSVKELSSSTQKLAQMMKSLQVDFGFLKQLLQLKFEDRLKEESLSLFTILHDRILEIEKHYQQNEDKMRKSFNQQLADAIAVIKGMYQPL

SEQ ID NO: 15527 - protein, 296 aa, Homo sapiens
  Payload ID: 3081
  Gene Symbol: C10orf67
  Gene Name: chromosome 10 open reading frame 67
  ENSP ID: ENSP00000365683
GRKIMEGLEASIEQFQFNPRLNISDDLKIGFFSTDHATQTDSSEILSVKELSSSTQKLAQMMKSLQVDFGFLKQLLQLKFEDRLKEESLSLFTILHDRILEIEKHYQQNEDKMRKSFNQQLADAIAVIKGMYQQFFEVEEENVSLQDASTVKTNILLRKLKEKEEVIKELKEELDQYKDFGFHKMESFAKETSSPKSNLEKENLEYKVENERLLQIISELEEEIQINLKENSGLEDELISMKEMAEKDHKTIQKLMDSRDRLREELHYEKSLVQDVINKQKEDKEMRKKYGSLSVK

SEQ ID NO: 15528 - protein, 1435 aa, Homo sapiens
  Payload ID: 3082
  Gene Symbol: C10orf71
  Gene Name: chromosome 10 open reading frame 71
  Uniprot ID: Q711Q0
  ENSP ID: ENSP00000363259
MMQGNKKCTDAFSDSSSIGSVLDDADREVSSLTDRAFRSLCISEDTSFHDSYLAVSPDITRQVFGTFHQRTVGHTQRKSGIWSQLPSQGTEHSGWAATFQQLPKYVQGEEKYPKTSPPPTPVQRRLEVPVSGLRSSNKPVSKVSTLIKSFDRTESQRCESRPTASKPPALKNPPKFAPLPENSVNFCFDSAFLTVRRVPAEVSNTHQNSYQPGRKHGEQESSKNPEMACHGSSSFLPAANDTATLCESKFPSPHHKPVTGEPGRGKGTFLHSENSAFESWNAHQPKLLERKDTAGTVPESKAPKHYGDTTLLREPCPPERTVSPCQVQASCSQEENRLAAGALSTSIPWGCRDPGAQVFAVEGKAPSSQPDSQEKPAQPPWRKPKTGKKGKESLQDTLEEKTQTNQRGPPLYTKHNPQEQFSENNALDLPVEPNEHYDPPFNISKLLTPIIPSKHALDSADSQPAERTPSPPGQLNGYQEKEPSECQSRDSYKSKAPSLLFNLKDVRKRVKSTYSSSPLLKVLDEKTRGKVDGKQEPVSNGVILPNGLEESPPNELSKERPADDPTASHINPQKDPTADPSEPSADSYLTLSTAPTIAKAPFYVNGEAAERSSYENKEVEGELEMGPAGSSWCPDSREHRPRKHLSLRLCNRDPEPGGATEKMKTHQLENGLSRSVSQETEPEREAGLQNTHLNQKFFPGPLSPEEEDVFYSDSQSDFMPSLKGKAKFSTSSSDQSFASFDDQQKMWFTENQREDRRKDVSAGDSQKDEKENVMRKDELQYCALSNGHACLENRSQGEALQRERESVSGGRTRKASAEEANFRGSWIGENKGTTFSQAKDLTPSPSSASNRHMLFTIKDNTLRATPVIKPIMLPLLRTMSLEDSLSSGHKEEELPRPEWGEDPGFCAPENQDILGTSTPTNTRGTRVKCMANEVMEDPGQGSSMARMEASQPAPKGNFPSMPLVGEGDRVKAPPDAAPGLVASNCKSGSADSGKLAAPWHIPTIALPEGDIEDQPPPWQPENCWEEQTPGFKSHFLSTPRAGPPGRRLVPSERANSPNPGSPGESSACSPAASNIWEESSQAPGGPELLPEEPNQASPWASSSPARVTRREDLTHALVWEGGSDPLLELSAEDLRTLSPRGSLLDVATSPAGTSGRLELPAQLERTASKPPAVPPKTEKALRRAKKLASKRRKTDQAQEKHGESQEGKPCPEDLEQTQQRPLCPRERPRHNFPVVRSLPPPVHRHSVSGFSEPVGRRPGGPQSLTPLPAYPATQKVLQDPQSGEYFVFDLPLQVKIKTFYDPETGKYVKVSIPSSEGASPEPPPPDALAAPYVLYPGFQPVPVTALMPLRCSSQLSAPTFLRQGPRASAARARTQSVHESGLQLDPGPHGDCTPHSAGQRPHGPPQSPGEEGVEAPGLGIISTDDLEDFATEGIS

SEQ ID NO: 15529 - protein, 198 aa, Homo sapiens
  Payload ID: 3083
  Gene Symbol: C10orf76
  Gene Name: chromosome 10 open reading frame 76
  ENSP ID: ENSP00000312408
MAQVEKRGGLLRKSSASKKPLKEKVVLMYDEIFMTEDPSKCSPRFWEELFLMKVNLEYLEGKLESLDGEELMKIKDNINCLFQHCIQALGEEHPIRVVNALQTLCALIRGVHQKNKSTSGFDIINMLMGFDKAELCMKVRHKLQMCLWMAASDSCSWTLSADKCTQRFGLRKIQMIEFGLAFRCFYFTDLLYLNKGKF

SEQ ID NO: 15530 - protein, 689 aa, Homo sapiens
  Payload ID: 3083
  Gene Symbol: C10orf76
  Gene Name: chromosome 10 open reading frame 76
  Uniprot ID: Q5T2E6
  ENSP ID: ENSP00000359050
MAQVEKRGGLLRKSSASKKPLKEKVVLMYDEIFMTEDPSKCSPRFWEELFLMKVNLEYLEGKLESLDGEELMKIKDNINCLFQHCIQALGEEHPIRVVNALQTLCALIRGVHQKNKSTSGFDIINMLMGFDKAELCMKNLMESLDSLLCAEGSESLKSLCLKLLLCLVTVTDNISQNTILEYVMINSIFEAILQILSHPPSRREHGYDAVVLLALLVNYRKYESVNPYIVKLSIVDDEATLNGMGLVIAQALSEYNRQYKDKEEEHQSGFFSALTNMVGSMFIADAHEKISVQTNEAILLALYEAVHLNRNFITVLAQSHPEMGLVTTPVSPAPTTPVTPLGTTPPSSDVISSVELPLDADVQTSNLLITFLKYSSIVMQDTKDEHRLHSGKLCLIILTCIAEDQYANAFLHDDNMNFRVNLHRMPMRHRKKAADKNLPCRPLVCAVLDLMVEFIVTHMMKEFPMDLYIRCIQVVHKLLCYQKKCRVRLHYTWRELWSALINLLKFLMSNETVLLAKHNIFTLALMIVNLFNMFITYGDTFLPTPSSYDELYYEIIRMHQSFDNLYSMVLRLSTNAGQWKEAASKVTHALVNIRAIINHFNPKIESYAAVNHISQLSEEQVLEVVRANYDTLTLKLQDGLDQYERYSEQHKEAAFFKELVRSISTNVRRNLAFHTLSQEVLLKEFSTIS

SEQ ID NO: 15531 - protein, 94 aa, Homo sapiens
  Payload ID: 3083
  Gene Symbol: C10orf76
  Gene Name: chromosome 10 open reading frame 76
  ENSP ID: ENSP00000413473
SVELPLDADVQTSNLLITFLKYSSIVMQDTKDEHRLHSGKLCLIILTCIAEPMRHRKKAADKNLPCRPLVCAVLDLMVEFIVTHMMKEFPMDLY

SEQ ID NO: 15532 - protein, 154 aa, Homo sapiens
  Payload ID: 3084
  Gene Symbol: C10orf82
  Gene Name: chromosome 10 open reading frame 82
  Uniprot ID: Q8WW14
  ENSP ID: ENSP00000358212
MEPSKTFMRNLPITPGYSGFVPFLSCQGMSKEDDMNHCVKTFQEKTQRYKEQLRELCCAVATAPKLKPVNSEETVLQALHQYNLQYHPLILECKYVKKPLQEPPIPGWAGYLPRAKVTEFGCGTRYTVMAKNCYKDFLEITERAKKAHLKPYEE

SEQ ID NO: 15533 - protein, 234 aa, Homo sapiens
  Payload ID: 3084
  Gene Symbol: C10orf82
  Gene Name: chromosome 10 open reading frame 82
  ENSP ID: ENSP00000465712
MEPSKTFMRNLPITPGYSGFVPFLSCQGMSKEDDMNHCVKTFQEKTQRYKEQLRELCCAVATAPKLKPVNSEETVLQALHQYNLQYHPLILECKYVKKPLQEPPIPGWAGYLPRAKVTEFGCGTRYTVMAKNCYKDFLEITERAKKAHLKPYEEIYGVSSTKTSAPSPKVLQHEELLPKYPDFSIPDGSCPALGRPLREDPKTPLTCGCAQRPSIPCSGKMYLEPLSSAKYAEG

SEQ ID NO: 15534 - protein, 445 aa, Homo sapiens
  Payload ID: 3085
  Gene Symbol: C10orf88
  Gene Name: chromosome 10 open reading frame 88
  Uniprot ID: Q9H8K7
  ENSP ID: ENSP00000419126
METRTEDGGLTRRPTLASSWDVAGGALTHSLLLTRAGLGPGDFDWEELLAPPAPGQDLVILKRNHNNKDENPCFLYLRCGPDGGEEIASIGILSSARNMEVYLGEEYCGTSRGKNVCTVLDDSEHEKIILYKKNLKLESSTHACKIKLLSFGERQCVFISKVVVHMRSVFANSSTSSPALGSRIDLDKVQTIMESMGSKLSPGAQQLMDMVRCQQRNCIPIGEQLQSVLGNSGYKHMIGLQSSSTLGTLNKSSSTPFPFRTGLTSGNVTENLQTYIDKSTQLPGGENSTKLDECKVMPQNHSFLENDLKNAMASFLPKKVSDNSNIPNSELLPFLQNLCSQVNHLHVGNKTECQENITKHGERILGVGMEEQSICSYLEKILSKNMELMEKKLMDYIDQRIHELQEHIDDKIALLLDLLQNPNSPPTGIPLRHYDSGERLSNGER

SEQ ID NO: 15535 - protein, 699 aa, Homo sapiens
  Payload ID: 3086
  Gene Symbol: C10orf90
  Gene Name: chromosome 10 open reading frame 90
  Uniprot ID: Q96M02
  ENSP ID: ENSP00000284694
MLKLSGEGLRDSYHSRRDQIALKNLQSDVTEAKSDFTKETLASQNTKMISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRAVHTKVFSGSSKRQQGEVCMTVSAPPVEQKPTRHFLPIGDSSPSDDCLSRDLSEPTERRHQSFLKPRILFPGFLCPLQDVCASLQEDNGVQIESKFPKGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 15536 - protein, 660 aa, Homo sapiens
  Payload ID: 3086
  Gene Symbol: C10orf90
  Gene Name: chromosome 10 open reading frame 90
  ENSP ID: ENSP00000349318
MISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRAVHTKVFSGSSKRQQGEVCMTVSAPPVEQKPTRHFLPIGDSSPSDDCLSRDLSEPTERRHQSFLKPRILFPGFLCPLQDVCASLQEDNGVQIESKFPKGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKVMASSPAGVMCVVHRCRIST

SEQ ID NO: 15537 - protein, 662 aa, Homo sapiens
  Payload ID: 3086
  Gene Symbol: C10orf90
  Gene Name: chromosome 10 open reading frame 90
  ENSP ID: ENSP00000405995
MLKLSGEGLRDSYHSRRDQIALKNLQSDVTEAKSDFTKETLASQNTKMISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRAVHTKVFSGSSKRQQGEVCMTVSAPPVEQKPTRHFLPIGDSSPSDDCLSRDLSEPTERRHQSFLKPRILFPGFLCPLQDVCASLQEDNGVQIESKFPKGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEV

SEQ ID NO: 15538 - protein, 242 aa, Homo sapiens
  Payload ID: 3086
  Gene Symbol: C10orf90
  Gene Name: chromosome 10 open reading frame 90
  ENSP ID: ENSP00000411609
  MOD_RES (1)..(1): Any amino acid
XWSGSFPLENTELANVGANQVTVRKGEKDHTTHCHASDHANQLSIHIPGWSYRAGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 15539 - protein, 209 aa, Homo sapiens
  Payload ID: 3086
  Gene Symbol: C10orf90
  Gene Name: chromosome 10 open reading frame 90
  ENSP ID: ENSP00000474558
MISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRV

SEQ ID NO: 15540 - protein, 39 aa, Homo sapiens
  Payload ID: 3086
  Gene Symbol: C10orf90
  Gene Name: chromosome 10 open reading frame 90
  ENSP ID: ENSP00000474615
MLKLSGEGLRDSYHSRRDQIALKNLQSDVTEAKSDFTKV

SEQ ID NO: 15541 - protein, 103 aa, Homo sapiens
  Payload ID: 3086
  Gene Symbol: C10orf90
  Gene Name: chromosome 10 open reading frame 90
  ENSP ID: ENSP00000474753
MVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 15542 - protein, 81 aa, Homo sapiens
  Payload ID: 3087
  Gene Symbol: C10orf99
  Gene Name: chromosome 10 open reading frame 99
  Uniprot ID: Q6UWK7
  ENSP ID: ENSP00000361199
MRLLVLSSLLCILLLCFSIFSTEGKRRPAKAWSGRRTRLCCHRVPSPNSTNLKGHHVRLCKPCKLEPEPRLWVVPGALPQV

SEQ ID NO: 15543 - protein, 150 aa, Homo sapiens
  Payload ID: 3088
  Gene Symbol: C11orf1
  Gene Name: chromosome 11 open reading frame 1
  Uniprot ID: Q9H5F2
  ENSP ID: ENSP00000260276
MAASQCLCCSKFLFQRQNLACFLTNPHCGSLVNADGHGEVWTDWNNMSKFFQYGWRCTTNENTYSNRTLMGNWNQERYDLRNIVQPKPLPSQFGHYFETTYDTSYNNKMPLSTHRFKREPHWFPGHQPELDPPRYKCTEKSTYMNSYSKP

SEQ ID NO: 15544 - protein, 190 aa, Homo sapiens
  Payload ID: 3088
  Gene Symbol: C11orf1
  Gene Name: chromosome 11 open reading frame 1
  ENSP ID: ENSP00000431180
MVIWVILSLLGELGKPGLLTSLKNMEQPSKDFCDSHKKSSKSSTYSASSYSSSGKRQNLACFLTNPHCGSLVNADGHGEVWTDWNNMSKFFQYGWRCTTNENTYSNRTLMGNWNQERYDLRNIVQPKPLPSQFGHYFETTYDTSYNNKMPLSTHRFKREPHWFPGHQPELDPPRYKCTEKSTYMNSYSKP

SEQ ID NO: 15545 - protein, 142 aa, Homo sapiens
  Payload ID: 3088
  Gene Symbol: C11orf1
  Gene Name: chromosome 11 open reading frame 1
  ENSP ID: ENSP00000432128
MEQPSKDFCDSHKKSSKSSTYSASSYSSSGKRQNLACFLTNPHCGSLVNADGHGEVWTDWNNMSKFFQYGWRCTTNENTYSNRTLMGNWNQERYDLRNIVQPKPLPSQFGHYFETTYDTSYNNKMPLSTHRFKREPHWFPGH

SEQ ID NO: 15546 - protein, 104 aa, Homo sapiens
  Payload ID: 3088
  Gene Symbol: C11orf1
  Gene Name: chromosome 11 open reading frame 1
  ENSP ID: ENSP00000433224
MSKFFQYGWRCTTNENTYSNRTLMGNWNQERYDLRNIVQPKPLPSQFGHYFETTYDTSYNNKMPLSTHRFKREPHWFPGHQPELDPPRYKCTEKSTYMNSYSKP

SEQ ID NO: 15547 - protein, 121 aa, Homo sapiens
  Payload ID: 3088
  Gene Symbol: C11orf1
  Gene Name: chromosome 11 open reading frame 1
  ENSP ID: ENSP00000435864
MAASQCLCCSKFLFQRQNLACFLTNPHCGSLVNADGHGEVWTDWNNMSKFFQYGWRCTTNENTYSNRTLMGNWNQERYDLRNIVQPKPLPSQDLSESLTGSQDINLNWILPDTNAQKSQLT

SEQ ID NO: 15548 - protein, 467 aa, Homo sapiens
  Payload ID: 3089
  Gene Symbol: C11orf16
  Gene Name: chromosome 11 open reading frame 16
  Uniprot ID: Q9NQ32
  ENSP ID: ENSP00000318999
MESSTGPRMPLLKYCSVATSLKAPGWDGAAPPWDLSFTYPFALQAPWLTGHKPLARHASSCPCLHVADPAWQGPGWLGRAGDAANTWVLARREADGFYYRAQIKATPELERQGVLLVEFEAPLVAGPKLPAQQQRVVLEEDVIPLSPSVGYSLRPGDKVLALWEPGQQQYGPGTVLLGLEMRDPQRASKEKEITVHFWNGKAAKVPLGGVQSVSLTIWKKAVERLHKSFTREHPRPLHWAPCCSLLGPITGRITNELPPDAPFLCPLCHHHACCQLLCQGCLCGCPPCGTTWWPLTRTSEVMARELPELEPTAQLLPLEGPKEEKVAMHAPLAVSSSSSSSCEQDGVENDLEMGPPQRLMVNSAVNTDPIFLEMPLRQSGLCQPEWRYWKRNGPEPCLGKPGTRYSNICKEEKDHKQQRAQTAVVGTTKELVSKATHMKPPRTPPGEAEHRKRSQSLAICQWNKNSR

SEQ ID NO: 15549 - protein, 404 aa, Homo sapiens
  Payload ID: 3089
  Gene Symbol: C11orf16
  Gene Name: chromosome 11 open reading frame 16
  Uniprot ID: Q9NQ32
  ENSP ID: ENSP00000436818
MESSTGPRMPLLKYCSVATSLKAPGWDGAAPPWDLSFTYPFALQAPWLTGHKPLARHASSCPCLHVADPAWQGPGWLGRAGDAANTWVLARREADGFYYRAQIKATPELERQGVLLVEFEAPLVAGPKLPAQQQRVVLEEDVIPLSPSVGYSLRPGDKVLALWEPGQQQYGPGTVLLGLEMRDPQRASKEKEITVHFWNGKAAKVPLGGVQSVSLTIWKKAVERLHKSFTREHPRPLHWAPCCSLLGPITGRITNELPPDAPFLCPLCHHHACCQLLCQGCLCGCPPCGTTWWPLTRTSEVMARELPELEPTAQLLPLEGPKEEKVAMHAPLAVSSSSSSSCEQDGVENDLEMGPPQRLMVNSAVNTDPIFLEMPLRQSGLCQPEWRYWKRNGPEPCLGKPGKE

SEQ ID NO: 15550 - protein, 128 aa, Homo sapiens
  Payload ID: 3089
  Gene Symbol: C11orf16
  Gene Name: chromosome 11 open reading frame 16
  ENSP ID: ENSP00000437069
MESSTGPRMPLLKYCSVATSLKAPGWDGAAPPWDLSFTYPFALQAPWLTGHKPLARHASSCPCLHVADPAWQGPGWLGRAGDAANTWVLARREADGFYYRAQIKATPEGSAEGSSVATIAPCLHEPHR

SEQ ID NO: 15551 - protein, 132 aa, Homo sapiens
  Payload ID: 3090
  Gene Symbol: C11orf21
  Gene Name: chromosome 11 open reading frame 21
  Uniprot ID: Q9P2W6
  ENSP ID: ENSP00000370545
MGRTWCGMWRRRRPGRRSAVPRWPHLSSQSGVEPPDRWTGTPGWPSRDQEAPGSMMPPAAAQPSAHGALVPPATAHEPVDHPALHWLACCCCLSLPGQLPLAIRLGWDLDLEAGPSSGKLCPRARRWQPLPS

SEQ ID NO: 15552 - protein, 178 aa, Homo sapiens
  Payload ID: 3090
  Gene Symbol: C11orf21
  Gene Name: chromosome 11 open reading frame 21
  ENSP ID: ENSP00000406541
MASFLVWPLRTALRGGKSWAGPGVGCGGDGARGGGELSLSNLDLPGAGEAGLEHHPLLGHLFISAVPRWPHLSSQSGVEPPDRWTGTPGWPSRDQEAPGSMMPPAAAQPSAHGALVPPATAHEPVDHPALHWLACCCCLSLPGQLPLAIRLGWDLDLEAGPSSGKLCPRARRWQPLPS

SEQ ID NO: 15553 - protein, 449 aa, Homo sapiens
  Payload ID: 3091
  Gene Symbol: C11orf24
  Gene Name: chromosome 11 open reading frame 24
  Uniprot ID: Q96F05
  ENSP ID: ENSP00000307264
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGGAADGVTSIAPTAVASSTTAASITTAASSMTVASSAPTTAASSTTVASIAPTTAASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPTPTVVTTTKAQAREPTASPVPVPHTSPIPEMEAMSPTTQPSPMPYTQRAAGPGTSQAPEQVETEATPGTDSTGPTPRSSGGTKMPATDSCQPSTQGQYMVVTTEPLTQAVVDKTLLLVVLLLGVTLFITVLVLFALQAYESYKKKDYTQVDYLINGMYADSEM

SEQ ID NO: 15554 - protein, 114 aa, Homo sapiens
  Payload ID: 3091
  Gene Symbol: C11orf24
  Gene Name: chromosome 11 open reading frame 24
  ENSP ID: ENSP00000434144
MWTALVLIWIFSLSLSESHAASNDPRNFVPNKMWKGLVKRNASVETVDNKTSEDVTMAAASPVTLTKGTSAAHLNSMEVTTEDTSRTDAYESYKKKDYTQVDYLINGMYADSEM

SEQ ID NO: 15555 - protein, 25 aa, Homo sapiens
  Payload ID: 3091
  Gene Symbol: C11orf24
  Gene Name: chromosome 11 open reading frame 24
  ENSP ID: ENSP00000436765
MWTALVLIWIFSLSLSESHAASNDP

SEQ ID NO: 15556 - protein, 1322 aa, Homo sapiens
  Payload ID: 3092
  Gene Symbol: C11orf30
  Gene Name: chromosome 11 open reading frame 30
  Uniprot ID: Q7Z589
  ENSP ID: ENSP00000334130
MPVVWPTLLDLSRDECKRILRKLELEAYAGVISALRAQGDLTKEKKDLLGELSKVLSISTERHRAEVRRAVNDERLTTIAHNMSGPNSSSEWSIEGRRLVPLMPRLVPQTAFTVTANAVANAAIQHNASLPVPAETGSKEVVCYSYTSTTSTPTSTPVPSGSIATVKSPRPASPASNVVVLPSGSTVYVKSVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQGVSTSAIKMASTRLPSPKSLVSAPTQILAQFPKQHQQSPKQQLYQVQQQTQQQVAQPSPVSHQQQPQQSPLPPGIKPTIQIKQESGVKIITQQVQPSKILPKPVTATLPTSSNSPIMVVSSNGAIMTTKLVTTPTGTQATYTRPTVSPSIGRMAATPGAATYVKTTSGSIITVVPKSLATLGGKIISSNIVSGTTTKITTIPMTSKPNVIVVQKTTGKGTTIQGLPGKNVVTTLLNAGGEKTIQTVPTGAKPAILTATRPITKMIVTQPKGIGSTVQPAAKIIPTKIVYGQQGKTQVLIKPKPVTFQATVVSEQTRQLVTETLQQASRVAEAGNSSIQEGKEEPQNYTDSSSSSTESSQSSQDSQPVVHVIASRRQDWSEHEIAMETSPTIIYQDVSSESQSATSTIKALLELQQTTVKEKLESKPRQPTIDLSQMAVPIQMTQEKRHSPESPSIAVVESELVAEYITTERTDEGTEVAFPLLVSHRSQPQQPSQPQRTLLQHVAQSQTATQTSVVVKSIPASSPGAITHIMQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQVEQPIITQGSSVTKITFEGRQPPTVTKITGGSSVPKLTSPVTSISPIQASEKTAVSDILKMSLMEAQIDTNVEHMIVDPPKKALATSMLTGEAGSLPSTHMVVAGMANSTPQQQKCRESCSSPSTVGSSLTTRKIDPPAVPATGQFMRIQNVGQKKAEESPAEIIIQAIPQYAIPCHSSSNVVVEPSGLLELNNFTSQQLDDEETAMEQDIDSSTEDGTEPSPSQSSAERS

SEQ ID NO: 15557 - protein, 1224 aa, Homo sapiens
  Payload ID: 3092
  Gene Symbol: C11orf30
  Gene Name: chromosome 11 open reading frame 30
  ENSP ID: ENSP00000431166
MPVVWPTLLDLSRDECKRILRKLELEAYAGVISALRAQGDLTKEKKDLLGELSKVLSISTERHRAEVRRAVNDERLTTIAHNMSGPNSSSEWSIEGRRLVPLMPRLVPQTAFTVTANAVANAAIQHNASLPVPAETGSKEVVVCYSYTSTTSTPTSTPVPSGSIATVKSPRPASPASNVVVLPSGSTVYVKSVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQGVKIITQQVQPSKILPKPVTATLPTSSNSPIMVVSSNGAIMTTKLVTTPTGTQATYTRPTVSPSIGRMAATPGAATYVKTTSGSIITVVPKSLATLGGKIISSNIVSGTTTKITTIPMTSKPNVIVVQKTTGKGTTIQGLPGKNVVTTLLNAGGEKTIQTVPTGAKPAILTATRPITKMIVTQPKGIGSTVQPAAKIIPTKIVYGQQGKTQVLIKPKPVTFQATVVSEQTRQLVTETLQQASRVAEAGNSSIQEGKEEPQNYTDSSSSSTESSQSSQDSQPVVHVIASRRQDWSEHEIAMETSPTIIYQDVSSESQSATSTIKALLELQQTTVKEKLESKPRQPTIDLSQMAVPIQMTQEKRHSPESPSIAVVESELVAEYITTVSHRSQPQQPSQPQRTLLQHVAQSQTATQTSVVVKSIPASSPGAITHIMQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQVEQPIITQGSSVTKITFEGRQPPTVTKITGGSSVPKLTSPVTSISPIQASEKTAVSDILKMSLMEAQIDTNVEHMIVDPPKKALATSMLTGEAGSLPSTHMVVAGMANSTPQQQKCRESCSSPSTVGSSLTTRKIDPPAVPATGQFMRIQNVGQKKAEESPAEIIIQAIPQYAIPCHSSSNVVVEPSGLLELNNFTSQQLDDEETAMEQDIDSSTEDGTEPSPSQSSAERS

SEQ ID NO: 15558 - protein, 1323 aa, Homo sapiens
  Payload ID: 3092
  Gene Symbol: C11orf30
  Gene Name: chromosome 11 open reading frame 30
  Uniprot ID: Q7Z589
  ENSP ID: ENSP00000432010
MPVVWPTLLDLSRDECKRILRKLELEAYAGVISALRAQGDLTKEKKDLLGELSKVLSISTERHRAEVRRAVNDERLTTIAHNMSGPNSSSEWSIEGRRLVPLMPRLVPQTAFTVTANAVANAAIQHNASLPVPAETGSKEVVVCYSYTSTTSTPTSTPVPSGSIATVKSPRPASPASNVVVLPSGSTVYVKSVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQGVSTSAIKMASTRLPSPKSLVSAPTQILAQFPKQHQQSPKQQLYQVQQQTQQQVAQPSPVSHQQQPQQSPLPPGIKPTIQIKQESGVKIITQQVQPSKILPKPVTATLPTSSNSPIMVVSSNGAIMTTKLVTTPTGTQATYTRPTVSPSIGRMAATPGAATYVKTTSGSIITVVPKSLATLGGKIISSNIVSGTTTKITTIPMTSKPNVIVVQKTTGKGTTIQGLPGKNVVTTLLNAGGEKTIQTVPTGAKPAILTATRPITKMIVTQPKGIGSTVQPAAKIIPTKIVYGQQGKTQVLIKPKPVTFQATVVSEQTRQLVTETLQQASRVAEAGNSSIQEGKEEPQNYTDSSSSSTESSQSSQDSQPVVHVIASRRQDWSEHEIAMETSPTIIYQDVSSESQSATSTIKALLELQQTTVKEKLESKPRQPTIDLSQMAVPIQMTQEKRHSPESPSIAVVESELVAEYITTERTDEGTEVAFPLLVSHRSQPQQPSQPQRTLLQHVAQSQTATQTSVVVKSIPASSPGAITHIMQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQVEQPIITQGSSVTKITFEGRQPPTVTKITGGSSVPKLTSPVTSISPIQASEKTAVSDILKMSLMEAQIDTNVEHMIVDPPKKALATSMLTGEAGSLPSTHMVVAGMANSTPQQQKCRESCSSPSTVGSSLTTRKIDPPAVPATGQFMRIQNVGQKKAEESPAEIIIQAIPQYAIPCHSSSNVVVEPSGLLELNNFTSQQLDDEETAMEQDIDSSTEDGTEPSPSQSSAERS

SEQ ID NO: 15559 - protein, 217 aa, Homo sapiens
  Payload ID: 3092
  Gene Symbol: C11orf30
  Gene Name: chromosome 11 open reading frame 30
  ENSP ID: ENSP00000432234
GEKTIQTVPTGAKPAILTATRPITKMIVTQPKGIGSTVQPAAKIIPTKIVYGQQGKTQVLIKPKPVTFQATVVSEQTRQLVTETLQQASRVAEAGNSSIQEGKEEPQNYTDSSSSSTESSQSSQVSHRSQPQQPSQPQRTLLQHVAQSQTATQTSVVVKSIPASSPGAITHIMQQALSSHTAFTKHSEELGTEEGEVEEMDTLDPQTGLFYRSALTQ

SEQ ID NO: 15560 - protein, 1322 aa, Homo sapiens; identical to SEQ ID NO: 15556
  Payload ID: 3092
  Gene Symbol: C11orf30
  Gene Name: chromosome 11 open reading frame 30
  Uniprot ID: Q7Z589
  ENSP ID: ENSP00000432327

SEQ ID NO: 15561 - protein, 1337 aa, Homo sapiens
  Payload ID: 3092
  Gene Symbol: C11orf30
  Gene Name: chromosome 11 open reading frame 30
  Uniprot ID: Q7Z589
  ENSP ID: ENSP00000433205
MPVVWPTLLDLSRDECKRILRKLELEAYAGVISALRAQGDLTKEKKDLLGELSKVLSISTERHRAEVRRAVNDERLTTIAHKMNLSLYLGERPSYSMSGPNSSSEWSIEGRRLVPLMPRLVPQTAFTVTANAVANAAIQHNASLPVPAETGSKEVVVCYSYTSTTSTPTSTPVPSGSIATVKSPRPASPASNVVVLPSGSTVYVKSVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQGVSTSAIKMASTRLPSPKSLVSAPTQILAQFPKQHQQSPKQQLYQVQQQTQQQVAQPSPVSHQQQPQQSPLPPGIKPTIQIKQESGVKIITQQVQPSKILPKPVTATLPTSSNSPIMVVSSNGAIMTTKLVTTPTGTQATYTRPTVSPSIGRMAATPGAATYVKTTSGSIITVVPKSLATLGGKIISSNIVSGTTTKITTIPMTSKPNVIVVQKTTGKGTTIQGLPGKNVVTTLLNAGGEKTIQTVPTGAKPAILTATRPITKMIVTQPKGIGSTVQPAAKIIPTKIVYGQQGKTQVLIKPKPVTFQATVVSEQTRQLVTETLQQASRVAEAGNSSIQEGKEEPQNYTDSSSSSTESSQSSQDSQPVVHVIASRRQDWSEHEIAMETSPTIIYQDVSSESQSATSTIKALLELQQTTVKEKLESKPRQPTIDLSQMAVPIQMTQEKRHSPESPSIAVVESELVAEYITTERTDEGTEVAFPLLVSHRSQPQQPSQPQRTLLQHVAQSQTATQTSVVVKSIPASSPGAITHIMQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQVEQPIITQGSSVTKITFEGRQPPTVTKITGGSSVPKLTSPVTSISPIQASEKTAVSDILKMSLMEAQIDTNVEHMIVDPPKKALATSMLTGEAGSLPSTHMVVAGMANSTPQQQKCRESCSSPSTVGSSLTTRKIDPPAVPATGQFMRIQNVGQKKAEESPAEIIIQAIPQYAIPCHSSSNVVVEPSGLLELNNFTSQQLDDEETAMEQDIDSSTEDGTEPSPSQSSAERS

SEQ ID NO: 15562 - protein, 1231 aa, Homo sapiens
  Payload ID: 3092
  Gene Symbol: C11orf30
  Gene Name: chromosome 11 open reading frame 30
  Uniprot ID: Q7Z589
  ENSP ID: ENSP00000433634
MPVVWPTLLDLSRDECKRILRKLELEAYAGVISALRAQGDLTKEKKDLLGELSKVLSISTERHRAEVRRAVNDERLTTIAHKMNLSLYLGERPSYSMSGPNSSSEWSIEGRRLVPLMPRLVPQTAFTVTANAVANAAIQHNASLPVPAETGSKEVVCYSYTSTTSTPTSTPVPSGSIATVKSPRPASPASNVVVLPSGSTVYVKSVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQGVSTSAIKMASTRLPSPKSLVSAPTQILAQFPKQHQQSPKQQLYQVQQQTQQQVAQPSPVSHQQQPQQSPLPPGIKPTIQIKQESGVKIITQQVQPSKILPKPVTATLPTSSNSPIMVVSSNGAIMTTKLVTTPTGTQATYTRPTVSPSIGRMAATPGAATYVKTTSGSIITVVPKSLATLGGKIISSNIVSGTTTKITTIPMTSKPNVIVVQKTTGKGTTIQGLPGKNVVTTLLNAGGEKTIQTVPTGAKPAILTATRPITKMIVTQPKGIGSTVQPAAKIIPTKIVYGQQGKTQVLIKPKPVTFQATVVSEQTRQLVTETLQQASRVAEAGNSSIQEGKEEPQNYTDSSSSSTESSQSSQDAVVISGEISSPPLFSVSHRSQPQQPSQPQRTLLQHVAQSQTATQTSVVVKSIPASSPGAITHIMQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQVEQPIITQGSSVTKITFEGRQPPTVTKITGGSSVPKLTSPVTSISPIQASEKTAVSDILKMSLMEAQIDTNVEHMIVDPPKKALATSMLTGEAGSLPSTHMVVAGMANSTPQQQKCRESCSSPSTVGSSLTTRKIDPPAVPATGQFMRIQNVGQKKAEESPAEIIIQAIPQYAIPCHSSSNVVVEPSGLLELNNFTSQQLDDEETAMEQDIDSSTEDGTEPSPSQSSAERS

SEQ ID NO: 15563 - protein, 107 aa, Homo sapiens
  Payload ID: 3092
  Gene Symbol: C11orf30
  Gene Name: chromosome 11 open reading frame 30
  ENSP ID: ENSP00000433670
ITQQVQPSKILPKPVTATLPTSSNSPIMVVSSNGAIMTTKLVTTPTGTQATYTRPTVSPSIGRMAATPGAATYVKTTSGSIITVVPKSLATLGGKIISSNIVSGRYI

SEQ ID NO: 15564 - protein, 109 aa, Homo sapiens
  Payload ID: 3092
  Gene Symbol: C11orf30
  Gene Name: chromosome 11 open reading frame 30
  ENSP ID: ENSP00000434566
MPVVWPTLLDLSRDECKRILRKLGVKIITQQVQPSKILPKPVTATLPTSSNSPIMVVSSNGAIMTTKLVTTPTGTQATYTRPTVSPSIGRMAATPGAATYVKTTSGSII

SEQ ID NO: 15565 - protein, 82 aa, Homo sapiens
  Payload ID: 3092
  Gene Symbol: C11orf30
  Gene Name: chromosome 11 open reading frame 30
  Uniprot ID: Q7Z589
  ENSP ID: ENSP00000434665
MPVVWPTLLDLSRDECKRILRKLELEAYAGVISALRAQGDLTKEKKDLLGELSKVLSISTERHRAEVRRAVNDERLTTIAHK

SEQ ID NO: 15566 - protein, 159 aa, Homo sapiens
  Payload ID: 3092
  Gene Symbol: C11orf30
  Gene Name: chromosome 11 open reading frame 30
  ENSP ID: ENSP00000436307
  MOD_RES (1)..(1): Any amino acid
XKTAVSDILKMSLMEAQIDTNVEHMIVDPPKKALATSMLTGEAGSLPSTHMVVAGMANSTPQQQKCRESCSSPSTVGSSLTTRKIDPPAVPATGQFMRIQNVGQKKAEESPAEIIIQVKTKELLSPGYPLEVVFYLPLSLQGYSSVCYSLSLQLQCGGG

SEQ ID NO: 15567 - protein, 295 aa, Homo sapiens
  Payload ID: 3092
  Gene Symbol: C11orf30
  Gene Name: chromosome 11 open reading frame 30
  ENSP ID: ENSP00000436528
QPSQPQRTLLQHVAQSQTATQTSVVVKSIPASSPGAITHIMQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQAIPQYAIPCHSSSNVVVEPSGLLELNNFTSQQLDDEETAMEQDIDSSTEDGTEPSPSQSSAERS

SEQ ID NO: 15568 - protein, 1323 aa, Homo sapiens
  Payload ID: 3092
  Gene Symbol: C11orf30
  Gene Name: chromosome 11 open reading frame 30
  Uniprot ID: Q7Z589
  ENSP ID: ENSP00000436968
MPVVWPTLLDLSRDECKRILRKLELEAYAGVISALRAQGDLTKEKKDLLGELSKVLSISTERHRAEVRRAVNDERLTTIAHKMNLSLYLGERPSYSMSGPNSSSEWSIEGRRLVPLMPRLVPQTAFTVTANAVANAAIQHNASLPVPAETGSKEVVVCYSYTSTTSTPTSTPVPSGSIATVKSPRPASPASNVVVLPSGSTVYVKSVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQGVSTSAIKMASTRLPSPKSLVSAPTQILAQFPKQHQQSPKQQLYQVQQQTQQQVAQPSPVSHQQQPQQSPLPPGIKPTIQIKQESGVKIITQQVQPSKILPKPVTATLPTSSNSPIMVVSSNGAIMTTKLVTTPTGTQATYTRPTVSPSIGRMAATPGAATYVKTTSGSIITVVPKSLATLGGKIISSNIVSGTTTKITTIPMTSKPNVIVVQKTTGKGTTIQGLPGKNVVTTLLNAGGEKTIQTVPTGAKPAILTATRPITKMIVTQPKGIGSTVQPAAKIIPTKIVYGQQGKTQVLIKPKPVTFQATVVSEQTRQLVTETLQQASRVAEAGNSSIQEGKEEPQNYTDSSSSSTESSQSSQDSQPVVHVIASRRQDWSEHEIAMETSPTIIYQDVSSESQSATSTIKALLELQQTTVKEKLESKPRQPTIDLSQMAVPIQMTQEKRHSPESPSIAVVESELVAEYITTVSHRSQPQQPSQPQRTLLQHVAQSQTATQTSVVVKSIPASSPGAITHIMQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQVEQPIITQGSSVTKITFEGRQPPTVTKITGGSSVPKLTSPVTSISPIQASEKTAVSDILKMSLMEAQIDTNVEHMIVDPPKKALATSMLTGEAGSLPSTHMVVAGMANSTPQQQKCRESCSSPSTVGSSLTTRKIDPPAVPATGQFMRIQNVGQKKAEESPAEIIIQAIPQYAIPCHSSSNVVVEPSGLLELNNFTSQQLDDEETAMEQDIDSSTEDGTEPSPSQSSAERS

SEQ ID NO: 15569 - protein, 122 aa, Homo sapiens
  Payload ID: 3093
  Gene Symbol: C11orf31
  Gene Name: chromosome 11 open reading frame 31
  Uniprot ID: Q8IZQ5
  ENSP ID: ENSP00000373509
  MOD_RES (44)..(44): Selenocysteine
MAPRGRKRKAEAAVVAVAEKREKLANGGEGMEEATVVIEHCTSXRVYGRNAAALSQALRLEAPELPVKVNPTKPRRGSFEVTLLRPDGSSAELWTGIKKGPPRKLKFPEPQEVVEELKKYLS

SEQ ID NO: 15570 - protein, 122 aa, Homo sapiens; identical to SEQ ID NO: 15569
  Payload ID: 3093
  Gene Symbol: C11orf31
  Gene Name: chromosome 11 open reading frame 31
  Uniprot ID: Q8IZQ5
  ENSP ID: ENSP00000434511
  MOD_RES (44)..(44): Selenocysteine

SEQ ID NO: 15571 - protein, 94 aa, Homo sapiens
  Payload ID: 3093
  Gene Symbol: C11orf31
  Gene Name: chromosome 11 open reading frame 31
  ENSP ID: ENSP00000434875
  MOD_RES (1)..(1): Any amino acid
  MOD_RES (16)..(16): Selenocysteine
XGMEEATVVIEHCTSXRVYGRNAAALSQALRLEAPELPVKVNPTKPRRGSFEVTLLRPDGSSAELWTGIKKGPPRKLKFPEPQEVVEELKKYLS

SEQ ID NO: 15572 - protein, 121 aa, Homo sapiens
  Payload ID: 3093
  Gene Symbol: C11orf31
  Gene Name: chromosome 11 open reading frame 31
  ENSP ID: ENSP00000481984
MAPRGRKRKAEAAVVAVAEKREKLANGGEGMEEATVVIEHCTSRVYGRNAAALSQALRLEAPELPVKVNPTKPRRGSFEVTLLRPDGSSAELWTGIKKGPPRKLKFPEPQEVVEELKKYLS

SEQ ID NO: 15573 - protein, 217 aa, Homo sapiens
  Payload ID: 3094
  Gene Symbol: C11orf40
  Gene Name: chromosome 11 open reading frame 40
  Uniprot ID: Q8WZ69
  ENSP ID: ENSP00000302918
MALVQALVPREREPKLSILQMDRGDPQHSSHWCPEREKVKLLTLKPRETSKNILINFYRAFNLDKDVFIHQANHPLTVPSSVVMGDNGHTLAEDDKRPCFRVLPCYLERVSSGISISWISAPLPVGAMKHQLLCDLMDLITLSFWLAGQCMSLKATNMQHCKCSIATSDWAIELDRTDYKTLPSEYSILALLQVFAGKNCMDRVLLHVDVNYLKSLP

SEQ ID NO: 15574 - protein, 333 aa, Homo sapiens
  Payload ID: 3095
  Gene Symbol: C11orf42
  Gene Name: chromosome 11 open reading frame 42
  Uniprot ID: Q8N5U0
  ENSP ID: ENSP00000321021
MLVGTPNLLTLDEADATWTLIKDKVIEEHFGPNAVAVPFLSDAACYDLLGVLVKQSRPAHTRLALPGRQGRRALKPVGPLPSLLEQAGSEGAFAHCTREYSPNGRAERAYEETRMLDGQPCKIRLHMGDLRKKVAFLLLPPGQVSLQQTLPWLRSTHSIYVIYQVFSCSWLQLGLTSTAREPQLLRLLRSLPVAFSCLKFSLQSKGVLGPQKPLTKDPLPHGANWVRPNLSIMPPLAPTSAPADTTEAADVPPPVPAPPTPPPQEGPEDKPTRFSYKGRNPFWRGPQILSENWLFSPRSPPPGAQGGGPRDPDGHSMSLPLLQGLSSEFDSDD

SEQ ID NO: 15575 - protein, 145 aa, Homo sapiens
  Payload ID: 3096
  Gene Symbol: C11orf45
  Gene Name: chromosome 11 open reading frame 45
  Uniprot ID: Q8TAV5
  ENSP ID: ENSP00000307879
MLTRLVLSAHLSSTTSPPWTHAAISWELDNVLMPSPRIWPQVTPTGRSASVRSEGNTSSLWNFSAGQDVHAIVTRTCESVLSSAVYTHGCGCVRSATNITCQSSGQQRQAARQEEENSICKAHDSREGRLGYPLSAHQPGSGGPN

SEQ ID NO: 15576 - protein, 145 aa, Homo sapiens; identical to SEQ ID NO: 15575
  Payload ID: 3096
  Gene Symbol: C11orf45
  Gene Name: chromosome 11 open reading frame 45
  Uniprot ID: Q8TAV5
  ENSP ID: ENSP00000431922

SEQ ID NO: 15577 - protein, 331 aa, Homo sapiens
  Payload ID: 3097
  Gene Symbol: C11orf49
  Gene Name: chromosome 11 open reading frame 49
  Uniprot ID: Q9H6J7
  ENSP ID: ENSP00000278460
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLAQVPGLVNSVTASPEASCLPSRTPPRVGSPWRPLHHSRKVDGESDGSTEETDESET

SEQ ID NO: 15578 - protein, 337 aa, Homo sapiens
  Payload ID: 3097
  Gene Symbol: C11orf49
  Gene Name: chromosome 11 open reading frame 49
  Uniprot ID: Q9H6J7
  ENSP ID: ENSP00000367878
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLLPFFRLAQVPGLVNSVTASPEASCLPSRTPPRVGSPWRPLHHSRKVDGESDGSTEETDESET

SEQ ID NO: 15579 - protein, 326 aa, Homo sapiens
  Payload ID: 3097
  Gene Symbol: C11orf49
  Gene Name: chromosome 11 open reading frame 49
  Uniprot ID: Q9H6J7
  ENSP ID: ENSP00000367881
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLVVRSKLHRTSRQHRAKEPGAFGFQRREKQEALERVSSASVPTPYHYRWEPRE

SEQ ID NO: 15580 - protein, 274 aa, Homo sapiens
  Payload ID: 3097
  Gene Symbol: C11orf49
  Gene Name: chromosome 11 open reading frame 49
  Uniprot ID: Q9H6J7
  ENSP ID: ENSP00000378844
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERL

SEQ ID NO: 15581 - protein, 49 aa, Homo sapiens
  Payload ID: 3097
  Gene Symbol: C11orf49
  Gene Name: chromosome 11 open reading frame 49
  ENSP ID: ENSP00000432186
MLSPERLALPDYEYLAQRHVLTYMEDAVCQLLENREDISQYGIARFFTE

SEQ ID NO: 15582 - protein, 61 aa, Homo sapiens
  Payload ID: 3097
  Gene Symbol: C11orf49
  Gene Name: chromosome 11 open reading frame 49
  ENSP ID: ENSP00000432535
MLSPERLALPDYEYLVLTVYAREHTFSFENSASSKPPPTIGYHFYGPSGDASELWAKMAIC

SEQ ID NO: 15583 - protein, 68 aa, Homo sapiens
  Payload ID: 3097
  Gene Symbol: C11orf49
  Gene Name: chromosome 11 open reading frame 49
  ENSP ID: ENSP00000433494
  MOD_RES (1)..(1): Any amino acid
XHNRVSFLRAFWRCFRTVGKNGDLLTMKEYHCLLQLLCPDFPLELTQKAARFSLSPSGLCSWTMPWTA

SEQ ID NO: 15584 - protein, 193 aa, Homo sapiens
  Payload ID: 3097
  Gene Symbol: C11orf49
  Gene Name: chromosome 11 open reading frame 49
  ENSP ID: ENSP00000433707
RVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALAATRKEKPISNWVTA

SEQ ID NO: 15585 - protein, 84 aa, Homo sapiens
  Payload ID: 3097
  Gene Symbol: C11orf49
  Gene Name: chromosome 11 open reading frame 49
  ENSP ID: ENSP00000434380
MLSPERLALPDYEYLGMLETITLLNVRYMKGHTSSALLVKWRGCQNRSAPWFSCPKVLQIDTSATCPHLHGGCSVPAARKQGRY

SEQ ID NO: 15586 - protein, 49 aa, Homo sapiens; identical to SEQ ID NO: 15581
  Payload ID: 3097
  Gene Symbol: C11orf49
  Gene Name: chromosome 11 open reading frame 49
  ENSP ID: ENSP00000436097

SEQ ID NO: 15587 - protein, 49 aa, Homo sapiens; identical to SEQ ID NO: 15581
  Payload ID: 3097
  Gene Symbol: C11orf49
  Gene Name: chromosome 11 open reading frame 49
  ENSP ID: ENSP00000436571

SEQ ID NO: 15588 - protein, 102 aa, Homo sapiens
  Payload ID: 3097
  Gene Symbol: C11orf49
  Gene Name: chromosome 11 open reading frame 49
  ENSP ID: ENSP00000436595
MLSPERLALPDYEYLAQRHVLTYMEDAVCQLLENREDISQYGIARFFTEYFNSVCQGTHILFREFSFVQATPHNRVSFLRAFWRCFRTVGKNGDFYIQGKPN

SEQ ID NO: 15589 - protein, 49 aa, Homo sapiens; identical to SEQ ID NO: 15581
  Payload ID: 3097
  Gene Symbol: C11orf49
  Gene Name: chromosome 11 open reading frame 49
  ENSP ID: ENSP00000437259

SEQ ID NO: 15590 - protein, 123 aa, Homo sapiens
  Payload ID: 3098
  Gene Symbol: C11orf52
  Gene Name: chromosome 11 open reading frame 52
  Uniprot ID: Q96A22
  ENSP ID: ENSP00000278601
MGNRVCCGGSWSCPSTFQKKKKTGSQTRRTLKPQPQQLQQNLPKGHETTGHTYERVLQQQGSQERSPGLMSEDSNLHYADIQVCSRPHAREVKHVHLENATEYATLRFPQATPRYDSKNGTLV

SEQ ID NO: 15591 - protein, 44 aa, Homo sapiens
  Payload ID: 3098
  Gene Symbol: C11orf52
  Gene Name: chromosome 11 open reading frame 52
  ENSP ID: ENSP00000436268
MGNRVCCGGSWSCPSTFQKKKKTGSQTRRTLKPQPQQLQQNLPK

SEQ ID NO: 15592 - protein, 236 aa, Homo sapiens
  Payload ID: 3099
  Gene Symbol: C11orf53
  Gene Name: chromosome 11 open reading frame 53
  Uniprot ID: Q8IXP5
  ENSP ID: ENSP00000280325
MPGSPVTSGYYGVRRSFLSDSDFHNSKQFSNDVYTSSVGKPFPCESSAGQSHAALLEPYFPQEPYGDYRPPALTPNAGSLFSASPLPPLLPPPFPGDPAHFLFRDSWEQTLPDGLSQPDPVSADALLTLPPSTSCLSQLESGSIAQHRGSSWGSSLAGAQSYSLHALEDLHHTPGYPTPPPYPFTPFMTVSNDLPPKVGPLSPDEEADTGSLHDPSPWVKEDGSIAWGSYECRRAY

SEQ ID NO: 15593 - protein, 315 aa, Homo sapiens
  Payload ID: 3100
  Gene Symbol: C11orf54
  Gene Name: chromosome 11 open reading frame 54
  Uniprot ID: Q9H0W9
  ENSP ID: ENSP00000331209
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVIEVKAKRRTGPLNFVTCMRETLEKHYGNKPIGMGGTFIIQKGKVKSHIMPAEFSSCPLNSDEEVNKWLHFYEMKAPLVCLPVFVSRDPGFDLRLEHTHFFSRHGEGGHYHYDTTPDIVEYLGYFLPAEFLYRIDQPKETHSIGRD

SEQ ID NO: 15594 - protein, 315 aa, Homo sapiens; identical to SEQ ID NO: 15593
  Payload ID: 3100
  Gene Symbol: C11orf54
  Gene Name: chromosome 11 open reading frame 54
  Uniprot ID: Q9H0W9
  ENSP ID: ENSP00000346403

SEQ ID NO: 15595 - protein, 265 aa, Homo sapiens
  Payload ID: 3100
  Gene Symbol: C11orf54
  Gene Name: chromosome 11 open reading frame 54
  Uniprot ID: Q9H0W9
  ENSP ID: ENSP00000433721
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKPAEFSSCPLNSDEEVNKWLHFYEMKAPLVCLPVFVSRDPGFDLRLEHTHFFSRHGEGGHYHYDTTPDIVEYLGYFLPAEFLYRIDQPKETHSIGRD

SEQ ID NO: 15596 - protein, 187 aa, Homo sapiens
  Payload ID: 3100
  Gene Symbol: C11orf54
  Gene Name: chromosome 11 open reading frame 54
  ENSP ID: ENSP00000433723
MPVIQTESEHKPPVNGSYFAHVNPADGGCLLEKYSEKCHDFQCALLANLFASEGQPGKVIEVKAKRRTGPLNFVTCMRETLEKHYGNKPIGMGGTFIIQKGKVKSHIMPAEFSSCPLNSDEEVNKWLHFYEMKAPLVCLPVFVSRDPGFDLRLEHTHFFSRHGEGGHYHYDTTPDIVEYLGYFLPAE

SEQ ID NO: 15597 - protein, 95 aa, Homo sapiens
  Payload ID: 3100
  Gene Symbol: C11orf54
  Gene Name: chromosome 11 open reading frame 54
  ENSP ID: ENSP00000434065
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFIL

SEQ ID NO: 15598 - protein, 76 aa, Homo sapiens
  Payload ID: 3100
  Gene Symbol: C11orf54
  Gene Name: chromosome 11 open reading frame 54
  ENSP ID: ENSP00000434291
MACAEFSFHVPSLEELAGVMQKGLKDNFADVQVSVVDCPDLTKEPFTFPVKGICGKTRIAEVGGVPYLLPLVNQKK

SEQ ID NO: 15599 - protein, 239 aa, Homo sapiens
  Payload ID: 3100
  Gene Symbol: C11orf54
  Gene Name: chromosome 11 open reading frame 54
  ENSP ID: ENSP00000434382
MQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVIEVKAKRRTGPLNFVTCMRETLEKHYGNKPIGMGGTFIIQKGKVKSHIMPAEFSSCPLNSDEEVNKWLHFYEMKAPLVCLPVFVSRDP

SEQ ID NO: 15600 - protein, 185 aa, Homo sapiens
  Payload ID: 3100
  Gene Symbol: C11orf54
  Gene Name: chromosome 11 open reading frame 54
  ENSP ID: ENSP00000434627
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEVIEVKAKRRTGPLNFVTCMRETLEKHYGNKPIGMGGTFIIQKGKVKSHIMPAEFSSCPLNSDEEVNKWLHFYEMK

SEQ ID NO: 15601 - protein, 315 aa, Homo sapiens; identical to SEQ ID NO: 15593
  Payload ID: 3100
  Gene Symbol: C11orf54
  Gene Name: chromosome 11 open reading frame 54
  Uniprot ID: Q9H0W9
  ENSP ID: ENSP00000435113

SEQ ID NO: 15602 - protein, 100 aa, Homo sapiens
  Payload ID: 3100
  Gene Symbol: C11orf54
  Gene Name: chromosome 11 open reading frame 54
  ENSP ID: ENSP00000435204
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAG

SEQ ID NO: 15603 - protein, 149 aa, Homo sapiens
  Payload ID: 3100
  Gene Symbol: C11orf54
  Gene Name: chromosome 11 open reading frame 54
  ENSP ID: ENSP00000435231
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKC

SEQ ID NO: 15604 - protein, 171 aa, Homo sapiens
  Payload ID: 3100
  Gene Symbol: C11orf54
  Gene Name: chromosome 11 open reading frame 54
  ENSP ID: ENSP00000435729
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVI

SEQ ID NO: 15605 - protein, 296 aa, Homo sapiens
  Payload ID: 3100
  Gene Symbol: C11orf54
  Gene Name: chromosome 11 open reading frame 54
  Uniprot ID: Q9H0W9
  ENSP ID: ENSP00000442094
MQKGLKDNFADVQVSVVDCPDLTKEPFTFPVKGICGKTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVIEVKAKRRTGPLNFVTCMRETLEKHYGNKPIGMGGTFIIQKGKVKSHIMPAEFSSCPLNSDEEVNKWLHFYEMKAPLVCLPVFVSRDPGFDLRLEHTHFFSRHGEGGHYHYDTTPDIVEYLGYFLPAEFLYRIDQPKETHSIGRD

SEQ ID NO: 15606 - protein, 256 aa, Homo sapiens
  Payload ID: 3100
  Gene Symbol: C11orf54
  Gene Name: chromosome 11 open reading frame 54
  ENSP ID: ENSP00000477694
MACAEFSFHVPSLEELAGVMQKGLKDNFADVQVSVVDCPDLTKEPFTFPVKGICGKTRIAEVGGVPYLLPLVNQKKVYDLNKIAKEIKLPGAFILGAGAGPFQTLGFNSEVIEVKAKRRTGPLNFVTCMRETLEKHYGNKPIGMGGTFIIQKGKVKSHIMPAEFSSCPLNSDEEVNKWLHFYEMKAPLVCLPVFVSRDPGFDLRLEHTHFFSRHGEGGHYHYDTTPDIVEYLGYFLPAEFLYRIDQPKETHSIGRD

SEQ ID NO: 15607 - protein, 292 aa, Homo sapiens
  Payload ID: 3101
  Gene Symbol: C11orf57
  Gene Name: chromosome 11 open reading frame 57
  Uniprot ID: Q6ZUT1
  ENSP ID: ENSP00000339076
MSRIPLGKVLLRNVIRHTDAHNKIQEESDMWKIRELEKQMEDAYRGTKRKMLPSSSSRMRSDGFDEESQRYYWRPKNEISGTLEDDFLKAKSWNKKFYDYEANMPDRWGHSGYKELYPEEFETDSDQQDITNGKKTSPQVKSSTHESRKHKKSKKSHKKKQKKRSHKKQKKSKKEATDITADSSSEFSEETGASGTRKGKQPHKRKKKSRKKSLKKPALFLEAESNTSHSDDSASSSSEESEERDTKKTKRKKREKKAHTSVANNEIQERTNKRTNWKVATDERSAESSEDD

SEQ ID NO: 15608 - protein, 293 aa, Homo sapiens
  Payload ID: 3101
  Gene Symbol: C11orf57
  Gene Name: chromosome 11 open reading frame 57
  Uniprot ID: Q6ZUT1
  ENSP ID: ENSP00000376767
MSRIPLGKVLLRNVIRHTDAHNKIQEESDMWKIRELEKQMEDAYRGTKRKMLPSSSSRMRSDGFDEESQRYYWRPKNEISGTLEDDFLKAKSWNKKFYDYEANMPDRWGHSGYKELYPEEFETDSSDQQDITNGKKTSPQVKSSTHESRKHKKSKKSHKKKQKKRSHKKQKKSKKEATDITADSSSEFSEETGASGTRKGKQPHKRKKKSRKKSLKKPALFLEAESNTSHSDDSASSSSEESEERDTKKTKRKKREKKAHTSVANNEIQERTNKRTNWKVATDERSAESSEDD

SEQ ID NO: 15609 - protein, 292 aa, Homo sapiens; identical to SEQ ID NO: 15607
  Payload ID: 3101
  Gene Symbol: C11orf57
  Gene Name: chromosome 11 open reading frame 57
  Uniprot ID: Q6ZUT1
  ENSP ID: ENSP00000402208

SEQ ID NO: 15610 - protein, 264 aa, Homo sapiens
  Payload ID: 3101
  Gene Symbol: C11orf57
  Gene Name: chromosome 11 open reading frame 57
  Uniprot ID: Q6ZUT1
  ENSP ID: ENSP00000432188
MWKIRELEKQMEDAYRGTKRKMLPSSSSRMRSDGFDEESQRYYWRPKNEISGTLEDDFLKAKSWNKKFYDYEANMPDRWGHSGYKELYPEEFETDSSDQQDITNGKKTSPQVKSSTHESRKHKKSKKSHKKKQKKRSHKKQKKSKKEATDITADSSSEFSEETGASGTRKGKQPHKRKKKSRKKSLKKPALFLEAESNTSHSDDSASSSSEESEERDTKKTKRKKREKKAHTSVANNEIQERTNKRTNWKVATDERSAESSEDD

SEQ ID NO: 15611 - protein, 63 aa, Homo sapiens
  Payload ID: 3101
  Gene Symbol: C11orf57
  Gene Name: chromosome 11 open reading frame 57
  ENSP ID: ENSP00000432677
MSRIPLGKVLLRNVIRHTDAHNKVGDSGGIRYVENKRTGKTDGRCLPGDQKENATQQFKPDAQ

SEQ ID NO: 15612 - protein, 113 aa, Homo sapiens
  Payload ID: 3101
  Gene Symbol: C11orf57
  Gene Name: chromosome 11 open reading frame 57
  ENSP ID: ENSP00000434054
MSSGTQMLTISRMRSDGFDEESQRYYWRPKNEISGTLEDDFLKAKSWNKKFYDYEANMPDRWGHSGYKELYPEEFETDSSDQQDITNGKKTSPQVKSSTHESRKHKKSKKSHK

SEQ ID NO: 15613 - protein, 215 aa, Homo sapiens
  Payload ID: 3101
  Gene Symbol: C11orf57
  Gene Name: chromosome 11 open reading frame 57
  ENSP ID: ENSP00000435408
MWKIRELEKQMEDAYRGTKRKMLPSSSSRMRSDGFDEESQRYYWRPKNEISGTLEDDFLKAKSWNKKFYDYEANMPDRWGHSGYKELYPEEFETDSSDQQDITNGKKTSPQVKSSTHESRKHKKSKKSHKKKQKKRSHKKQKKSKKEATDITADSSSEFSEETGASGTRKGKQPHKRKKKSRKKSLKKPALFLEAESNTSHSDDSASSSSEESEE

SEQ ID NO: 15614 - protein, 91 aa, Homo sapiens
  Payload ID: 3101
  Gene Symbol: C11orf57
  Gene Name: chromosome 11 open reading frame 57
  ENSP ID: ENSP00000436169
MSRIPLGKVLLRNVIRHTDAHNKIQEESDMWKIRELEKQMEDAYRGTKRKMLPSSSSRMRSDGFDEESQRYYWRPKNEISGTLEDDFLKAK

SEQ ID NO: 15615 - protein, 183 aa, Homo sapiens
  Payload ID: 3102
  Gene Symbol: C11orf58
  Gene Name: chromosome 11 open reading frame 58
  Uniprot ID: O00193
  ENSP ID: ENSP00000228136
MSAARESHPHGVKRSASPDDDLGSSNWEAADLGNEERKQKFLRLMGAGKKEHTGRLVIGDHKSTSHFRTGEEDKKINEELESQYQQSMDSKLSGRYRRHCGLGFSEVEDHDGEGDVAGDDDDDDDDSPDPESPDDSESDSESEKEESAEELQAAEHPDEVEDPKNKKDAKSNYKMMFVKSSGS

SEQ ID NO: 15616 - protein, 157 aa, Homo sapiens
  Payload ID: 3102
  Gene Symbol: C11orf58
  Gene Name: chromosome 11 open reading frame 58
  ENSP ID: ENSP00000431237
MSAARESHPHGVKRSASPDDDLGSSNWEAADLGNEERKQKFLRLMGAGKKEHTGRLVIGDHKSTSHFRTGEEDKKINEELESQYQQSMDSKLSGRYRRHCGLGFSERRSFAMLPRLVSKLLGSSDLSAFQSAGTTGVSHHVRPGHIFNRREQQHAHK

SEQ ID NO: 15617 - protein, 90 aa, Homo sapiens
  Payload ID: 3102
  Gene Symbol: C11orf58
  Gene Name: chromosome 11 open reading frame 58
  ENSP ID: ENSP00000432207
MSAARESHPHGVKRSASPDDDKEHTGRLVIGDHKSTSHFRTGEEDKKINEELESQYQQSMDSKLSGRYRRHCGLGFSEVEDHDGEGDVAG

SEQ ID NO: 15618 - protein, 86 aa, Homo sapiens
  Payload ID: 3102
  Gene Symbol: C11orf58
  Gene Name: chromosome 11 open reading frame 58
  ENSP ID: ENSP00000432534
MSAARESHPHGVKRSASPDDDLGSSNWEAADLGNEERKQKFLRLMGAGKGKKTRKLMKNWSLNISKVWTVNYQEDIGDIVDLASVR

SEQ ID NO: 15619 - protein, 778 aa, Homo sapiens
  Payload ID: 3103
  Gene Symbol: C11orf63
  Gene Name: chromosome 11 open reading frame 63
  Uniprot ID: Q6NUN7
  ENSP ID: ENSP00000227349
MSKRKLIPKLSIQSPVLHTNLNVQSTHPPLKKEDLHRISKDSLESDSESLTQEIMCHSEFDDRIRGNGMEPDSLDEEESPRWGSLHEMEEEASGKAAQMAREQNHHTWDQGANNRQQPIEDKYSDLRYDPNWKSKKEEGQLLSVEALPESTDSSLENLPLAPLYPSQETSMELSGGKGEQKESPQSAASLLGSEFLSPNYEHGARRSKPFSELSDSDLEEKSSSLSPYVKSSSSHNEVFLPGSRGPRRRKSKQHFVEKNKLTLGLPTPKTDSYLQLHNKKRGESHPEQISYPVRVTDKTSIQNAKEMENAAIDPEDKWHQRAQQLKNYQEHWSQYESTKSSNVPRGQPSDMVNDHQPSRRPAKLKIRKQCKHQNGLKSSTTEEVTASQGNQNNPPRQQQNQNKPLDTSTKPESIVIMHASNNDVQASRALRSHNLKETSNTFAPPKQAFDKVLSKNSTGCDSGLNVNKERGHKDQEEKRFSYQQLHTLSDMDLNNLNELSKRHVLLSQKGSQFVYHINTHGSTKNKKQLKQPYTETKYRNLEMLWKFHSSSDSQTVRASPDSWLTQIMEQHQQALVQLTDVQPSEGALSSVTLPPILSRVESESQLSSERSQRNQVKISRSNSEGYLFQLEKGKKHKKRSSSKNTKLKGYQKRDVKLGGLGPDFESIRDKTQKLIQQKEYAKQVKEYNMKTLSILSKPQTEKTQKKSAIPRQKALEYAKTIPKPKPSNLTHQASKEQKNPTYAGKEESLPEISLLEILQNRHEREKQAVAAFKVLHIV

SEQ ID NO: 15620 - protein, 307 aa, Homo sapiens
  Payload ID: 3103
  Gene Symbol: C11orf63
  Gene Name: chromosome 11 open reading frame 63
  Uniprot ID: Q6NUN7
  ENSP ID: ENSP00000307695
MSKRKLIPKLSIQSPVLHTNLNVQSTHPPLKKEDLHRISKDSLESDSESLTQEIMCHSEFDDRIRGNGMEPDSLDEEESPRWGSLHEMEEEASGKAAQMAREQNHHTWDQGANNRQQPIEDKYSDLRYDPNWKSKKEEGQLLSVEALPESTDSSLENLPLAPLYPSQETSMELSGGKGEQKESPQSAASLLGSEFLSPNYEHGARRSKPFSELSDSDLEEKSSSLSPYVKSSSSHNEVFLPGSRGPRRRKSKQHFVEKNKLTLGLPTPKTDSYLQLHNKKRGESHPEQVILRVNSLPRDGFKTFWSQ

SEQ ID NO: 15621 - protein, 778 aa, Homo sapiens; identical to SEQ ID NO: 15619
  Payload ID: 3103
  Gene Symbol: C11orf63
  Gene Name: chromosome 11 open reading frame 63
  Uniprot ID: Q6NUN7
  ENSP ID: ENSP00000431669

SEQ ID NO: 15622 - protein, 313 aa, Homo sapiens
  Payload ID: 3104
  Gene Symbol: C11orf65
  Gene Name: chromosome 11 open reading frame 65
  Uniprot ID: Q8NCR3
  ENSP ID: ENSP00000376799
MPWKEESEFTKQDKAARVIQQAWKSFLNVAIFQHFKSLIDLRRQGEPRQIVKYINPKEAELLDAAAGIHVRFRLGGVKFPPDIYYKIFTHRPIEDLCANSPRNYAKLPAKHTSHNKNDHLQEEDHSGWYHRIENNGWRPVSDTFWLSTDGMVVEDKKESEFHFSKLKRRQDLEKKRKLRKIEWMRQMYYSGSLEAKSTHHETLGLIHTATKGLIRAFEDGGIDSVMEWEVDEVLNWTNTLNFDEYIASWKEIATSNSSANFKGFRFNQAQKNIYNYGGDISKMQMGIPDDTYYENVYQEPNVTRLTPDSTYGL

SEQ ID NO: 15623 - protein, 313 aa, Homo sapiens; identical to SEQ ID NO: 15622
  Payload ID: 3104
  Gene Symbol: C11orf65
  Gene Name: chromosome 11 open reading frame 65
  Uniprot ID: Q8NCR3
  ENSP ID: ENSP00000431706

SEQ ID NO: 15624 - protein, 105 aa, Homo sapiens
  Payload ID: 3104
  Gene Symbol: C11orf65
  Gene Name: chromosome 11 open reading frame 65
  ENSP ID: ENSP00000432827
  MOD_RES (1)..(1): Any amino acid
XQDLEKKRKLRKIEWMRQMYYSGSLEAKSTHHETLGLIHTATKGLIRAFEDGGIDSVMEWEVDEVLNWTNTLNFDEDTKKMEKSLVLENNAFLLYKSSSFVYLHY

SEQ ID NO: 15625 - protein, 246 aa, Homo sapiens
  Payload ID: 3104
  Gene Symbol: C11orf65
  Gene Name: chromosome 11 open reading frame 65
  Uniprot ID: Q8NCR3
  ENSP ID: ENSP00000433395
MPWKEESEFTKQDKAARVIQQAWKSFLVKFPPDIYYKIFTHRPIEDLCANSPRNYAKLPAKHTSHNKNDHLQEEDHSGWYHRIENNGWRPVSDTFWLSTDGMVVEDKKESEFHFSKLKRRQDLEKKRKLRKIEWMRQMYYSGSLEAKSTHHETLGLIHTATKGLIRAFEDGGIDSVMEWEVDEVLNWTNTLNFDEYIASWKEIATSNSSANFKGIFFRILFSIKMEYEEFLSSPTPANVNTILPQW

SEQ ID NO: 15626 - protein, 190 aa, Homo sapiens
  Payload ID: 3104
  Gene Symbol: C11orf65
  Gene Name: chromosome 11 open reading frame 65
  ENSP ID: ENSP00000434500
MPWKEESEFTKQDKAARVIQQAWKSFLNVAIFQHFKSLIDLRRQGEPRQIVKYINPKEVKFPPDIYYKIFTHRPIEDLCANSPRNYAKLPAKHTSHNKNDHLQEEDHSGWYHRIENNGWRPVSDTFWLSTDGMVVEDKKESEFHFSKLKRRQDLEKKRKLRKIEWMRQMYYSGSLEAKSTHHETLGLIHT

SEQ ID NO: 15627 - protein, 313 aa, Homo sapiens; identical to SEQ ID NO: 15622
  Payload ID: 3104
  Gene Symbol: C11orf65
  Gene Name: chromosome 11 open reading frame 65
  Uniprot ID: Q8NCR3
  ENSP ID: ENSP00000436400

SEQ ID NO: 15628 - protein, 313 aa, Homo sapiens; identical to SEQ ID NO: 15622
  Payload ID: 3104
  Gene Symbol: C11orf65
  Gene Name: chromosome 11 open reading frame 65
  Uniprot ID: Q8NCR3
  ENSP ID: ENSP00000483537

SEQ ID NO: 15629 - protein, 293 aa, Homo sapiens
  Payload ID: 3105
  Gene Symbol: C11orf68
  Gene Name: chromosome 11 open reading frame 68
  Uniprot ID: Q9H3H3
  ENSP ID: ENSP00000398350
MAAAAAAAVAGVGRGGGGAEPRQERSRARGWAGVERSEGRSRMEPGEELEEEGSPGGREDGFTAEHLAAEAMAADMDPWLVFDARTTPATELDAWLAKYPPSQVTRYGDPGSPNSEPVGWIAVYGQGYSPNSGDVQGLQAAWEALQTSGRPITPGTLRQLAITHHVLSGKWLMHLAPGFKLDHAWAGIARAVVEGQLQVAKVSPRAKEGGRQVICVYTDDFTDRLGVLEADSAIRAAGIKCLLTYKPDVYTYLGIYRANRWHLCPTLYESRFQLGGSARGSRVLDRANNVELT

SEQ ID NO: 15630 - protein, 292 aa, Homo sapiens
  Payload ID: 3105
  Gene Symbol: C11orf68
  Gene Name: chromosome 11 open reading frame 68
  Uniprot ID: Q9H3H3
  ENSP ID: ENSP00000409681
MAAAAAAAVAGVGRGGGGAEPRQERSRARGWAGVERSEGRRMEPGEELEEEGSPGGREDGFTAEHLAAEAMAADMDPWLVFDARTTPATELDAWLAKYPPSQVTRYGDPGSPNSEPVGWIAVYGQGYSPNSGDVQGLQAAWEALQTSGRPITPGTLRQLAITHHVLSGKWLMHLAPGFKLDHAWAGIARAVVEGQLQVAKVSPRAKEGGRQVICVYTDDFTDRLGVLEADSAIRAAGIKCLLTYKPDVYTYLGIYRANRWHLCPTLYESRFQLGGSARGSRVLDRANNVELT

SEQ ID NO: 15631 - protein, 251 aa, Homo sapiens
  Payload ID: 3105
  Gene Symbol: C11orf68
  Gene Name: chromosome 11 open reading frame 68
  Uniprot ID: Q9H3H3
  ENSP ID: ENSP00000433914
MEPGEELEEEGSPGGREDGFTAEHLAAEAMAADMDPWLVFDARTTPATELDAWLAKYPPSQVTRYGDPGSPNSEPVGWIAVYGQGYSPNSGDVQGLQAAWEALQTSGRPITPGTLRQLAITHHVLSGKWLMHLAPGFKLDHAWAGIARAVVEGQLQVAKVSPRAKEGGRQVICVYTDDFTDRLGVLEADSAIRAAGIKCLLTYKPDVYTYLGIYRANRWHLCPTLYESRFQLGGSARGSRVLDRANNVELT

SEQ ID NO: 15632 - protein, 267 aa, Homo sapiens
  Payload ID: 3106
  Gene Symbol: C11orf70
  Gene Name: chromosome 11 open reading frame 70
  Uniprot ID: Q9BRQ4
  ENSP ID: ENSP00000414390
MATGELGDLGGYYFRFLPQKTFQSLSSKEITSRLRQWSMLGRIKAQAFGFDQTFQSYRKDDFVMAFFKDPNVIPNLKLLSDSSGQWIILGTEVKKIEAINVPCTQLSMSFFHRLYDEDIVRDSGHIVKCLDSFCDPFLISDELRRVLLVEDSEKYEIFSQPDREEFLFCLFKHLCLGGALCQYEDVISPYLETTKLIYKDLVSVRKNPQTKKIQITSSVFKVSAYDSAGMCYPSAKNHEQTFSYFIVDPIRRHLHVLYHCYGVGDMS

SEQ ID NO: 15633 - protein, 95 aa, Homo sapiens
  Payload ID: 3106
  Gene Symbol: C11orf70
  Gene Name: chromosome 11 open reading frame 70
  ENSP ID: ENSP00000432322
  MOD_RES (1)..(1): Any amino acid
XFFHRLYDEDIVRDSGHIVKCLDSFCDPFLISDELRRVLLVEDSEKYEIFSQPDREEFLFCLFKHLCLGGALCQYEDVISPYLETTKLIYKDLVR

SEQ ID NO: 15634 - protein, 241 aa, Homo sapiens
  Payload ID: 3106
  Gene Symbol: C11orf70
  Gene Name: chromosome 11 open reading frame 70
  ENSP ID: ENSP00000433074
MATGELGDLGGYYFRFLPQKTFQSLSSKEITSRLRQWSMLGRIKAQAFGFDQTFQSYRKDDFVMAFFKDPNVIPNLKLLSDSSGQWIILGTEVKKIEAINVPCTQLSMSFFHRLYDEDIVRDSGHIVKCLDSFCDPFLISDELRRVLLVEDSEKYEIFSQPDREEFLFCLFKHLCLGGALCQYEDVISPYLETTKLIYKDLVSVRKNPQTKKIQITSSVFKVSAYVSVRELLQPKNLITFY

SEQ ID NO: 15635 - protein, 99 aa, Homo sapiens
  Payload ID: 3106
  Gene Symbol: C11orf70
  Gene Name: chromosome 11 open reading frame 70
  Uniprot ID: Q9BRQ4
  ENSP ID: ENSP00000435482
MATGELGDLGGYYFRFLPQKTFQSLSSKEITSRLRQWSMLGRIKAQAFGFDQTFQSYRKDDFVMAFFKDPNVIPNLKLLSDSSGQWIILGFASGRLRKI

SEQ ID NO: 15636 - protein, 147 aa, Homo sapiens
  Payload ID: 3107
  Gene Symbol: C11orf71
  Gene Name: chromosome 11 open reading frame 71
  Uniprot ID: Q6IPW1
  ENSP ID: ENSP00000325508
MALNNVSLSSGDQRSRVAYRSSHGDLRPRASALAMVSGDGFLVSRPEAIHLGPRQAVRPSVRAESRRVDGGGRSPREPDGRGRSRQARFSPYPIPAVEPDLLRSVLQQRLIALGVTTWTLKLSESATPDLRWCSTCSHSNIFEILVI

SEQ ID NO: 15637 - protein, 123 aa, Homo sapiens
  Payload ID: 3107
  Gene Symbol: C11orf71
  Gene Name: chromosome 11 open reading frame 71
  Uniprot ID: Q6IPW1
  ENSP ID: ENSP00000488810
MALNNVSLSSGDQRSRVAYRSSHGDLRPRASALAMVSGDGFLVSRPEAIHLGPRQAVRPSVRAESRRVDGGGRSPREPDGRGRSRQARFSPYPIPAVEPDLLRSVLQQRLIALGGVIAARISV

SEQ ID NO: 15638 - protein, 197 aa, Homo sapiens
  Payload ID: 3108
  Gene Symbol: C11orf73
  Gene Name: chromosome 11 open reading frame 73
  Uniprot ID: Q53FT3
  ENSP ID: ENSP00000278483
MFGCLVAGRLVQTAAQQVAEDKFVFDLPDYESINHVVVFMLGTIPFPEGMGGSVYFSYPDSNGMPVWQLLGFVTNGKPSAIFKISGLKSGEGSQHPFGAMNIVRTPSVAQIGISVELLDSMAQQTPVGNAAVSSVDSFTQFTQKMLDNFYNFASSFAVSQAQMTPSPSEMFIPANVVLKWYENFQRRLAQNPLFWKT

SEQ ID NO: 15639 - protein, 194 aa, Homo sapiens
  Payload ID: 3108
  Gene Symbol: C11orf73
  Gene Name: chromosome 11 open reading frame 73
  ENSP ID: ENSP00000432699
MFGCLVAGRLVQTAAQQVAEDKFVFDLPDYESINHVVVFMLGTIPFPEGMGGSVYFSYPDSNGMPVWQLLGFVTNGKPSAIFKISGLKSGEGSQHPFGAMNIVRTPSVAQIGISVELLDSMAQQTPVGNAAVSSVDSFTQFTQKMLDNFYNFASSFAVSQAQMTPSPSEMFIPANVVLKWYEAFSVSNIKAFYN

SEQ ID NO: 15640 - protein, 92 aa, Homo sapiens
  Payload ID: 3108
  Gene Symbol: C11orf73
  Gene Name: chromosome 11 open reading frame 73
  ENSP ID: ENSP00000433815
MFGCLVAGRLVQTAAQQVAEDKFVFDLPDYESINHVVVFMLGTIPFPEGMGGSVYFSYPDSNGMPVWQLLGFVTNGKPSAIFKISGLKSGNY

SEQ ID NO: 15641 - protein, 131 aa, Homo sapiens [sequence omitted]

SEQ ID NO: 15642 - protein, 147 aa, Homo sapiens
  Payload ID: 3109
  Gene Symbol: C11orf74
  Gene Name: chromosome 11 open reading frame 74
  Uniprot ID: Q86VG3
  ENSP ID: ENSP00000299442
MSAHMSGLEIMDEDQLIKDVLDKFLNCHEQTYDEEFLNTFTHLSQDLLLLPGEVEQDVSTSIPSCIPFVAQPPTCEVKPKPSVKRMDKQTEEILGDEVQLFSLDEEFDYDNVMLTSKFSPAEIENIKELCKQQKRKDTSPDLEKSCD

SEQ ID NO: 15643 - protein, 221 aa, Homo sapiens
  Payload ID: 3109
  Gene Symbol: C11orf74
  Gene Name: chromosome 11 open reading frame 74
  Uniprot ID: Q86VG3
  ENSP ID: ENSP00000334848
MSAHMSGLEIMDEDQLIKDVLDKFLNCHEQTYDEEFLNTFTHLSQEDHVSKRGVFGTDSSENIFTSAKVTHKNEADDYHLRNKTIFLRTSSQCLEEQVDNFLDLEDLDMDEEIKPQMSEDLLLLPGEVEQDVSTSIPSCIPFVAQPPTCEVKPKPSVKRMDKQTEEILGDEVQLFSLDEEFDYDNVMLTSKFSPAEIENIKELCKQQKRKDTSPDLEKSCD

SEQ ID NO: 15644 - protein, 221 aa, Homo sapiens; identical to SEQ ID NO: 15643
  Payload ID: 3109
  Gene Symbol: C11orf74
  Gene Name: chromosome 11 open reading frame 74
  Uniprot ID: Q86VG3
  ENSP ID: ENSP00000403937

SEQ ID NO: 15645 - protein, 221 aa, Homo sapiens; identical to SEQ ID NO: 15643
  Payload ID: 3109
  Gene Symbol: C11orf74
  Gene Name: chromosome 11 open reading frame 74
  Uniprot ID: Q86VG3
  ENSP ID: ENSP00000431374

SEQ ID NO: 15646 - protein, 83 aa, Homo sapiens
  Payload ID: 3109
  Gene Symbol: C11orf74
  Gene Name: chromosome 11 open reading frame 74
  ENSP ID: ENSP00000432685
MSAHMSGLEIMDEDQLIKDVLDKFLNCHEQTYDEEFLNTFTHLSQEDHVSKRGVFGTDSSENIFTSAKVTHKNEADDYHLRNK

SEQ ID NO: 15647 - protein, 147 aa, Homo sapiens; identical to SEQ ID NO: 15642
  Payload ID: 3109
  Gene Symbol: C11orf74
  Gene Name: chromosome 11 open reading frame 74
  Uniprot ID: Q86VG3
  ENSP ID: ENSP00000433152

SEQ ID NO: 15648 - protein, 180 aa, Homo sapiens
  Payload ID: 3109
  Gene Symbol: C11orf74
  Gene Name: chromosome 11 open reading frame 74
  ENSP ID: ENSP00000433407
MSAHMSGLEIMDEDQLIKDVLDKFLNCHEQTYDEEFLNTFTHLSQEDHVSKRGVFGTDSSENIFTSAKVTHKNEADDYHLRNKTIFLRTSSQCLEEQVDNFLDLEDLDMDEEIKPQMSEDLLLLPGEVEQDVSTSIPSCIPFVAQPPTCEVKPKPSVKRMDKQTEEILGDEVQLFSLDEE

SEQ ID NO: 15649 - protein, 109 aa, Homo sapiens
  Payload ID: 3109
  Gene Symbol: C11orf74
  Gene Name: chromosome 11 open reading frame 74
  ENSP ID: ENSP00000435190
MSAHMSGLEIMDEDQLIKDVLDKFLNCHEQTYDEEFLNTFTHLSQEDHVSKRGVFGTDSSENIFTSAKVTHKNEADDYHLRNKTIFLRTSSQCLEEQICCCFQEKWSRM

SEQ ID NO: 15650 - protein, 90 aa, Homo sapiens
  Payload ID: 3109
  Gene Symbol: C11orf74
  Gene Name: chromosome 11 open reading frame 74
  ENSP ID: ENSP00000435676
MSAHMSGLEIMDEDQLIKDVLDKFLNCHEQTYDEEFLNTFTHLSQDLLLLPGEVEQDVSTSIPSCIPFVAQPPTCEVKPKPSVKRMDKQT

SEQ ID NO: 15651 - protein, 221 aa, Homo sapiens; identical to SEQ ID NO: 15643
  Payload ID: 3109
  Gene Symbol: C11orf74
  Gene Name: chromosome 11 open reading frame 74
  Uniprot ID: Q86VG3
  ENSP ID: ENSP00000483671

SEQ ID NO: 15652 - protein, 572 aa, Homo sapiens
  Payload ID: 3110
  Gene Symbol: C11orf80
  Gene Name: chromosome 11 open reading frame 80
  ENSP ID: ENSP00000354227
WSLTLLPRPECSGAVSAHCNLHLPGSSDSHASVPRVAGITDAHHHAWLIMVASAGSLFGGMVLKKFLKEIQSILPGISAKLTWTSEEGSYSQDMTGVTPFQMIFEVDEKPRTLMTDCLVIKHFLRKIIMVHPKVRFHFSVKVNGILSTEIFGVENEPTLNLGNGIALLVDSQHYVSRPNFGTIESHCSRIHPVLGHPVMLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 15653 - protein, 460 aa, Homo sapiens
  Payload ID: 3110
  Gene Symbol: C11orf80
  Gene Name: chromosome 11 open reading frame 80
  ENSP ID: ENSP00000431578
MTDCLVIKHFLRKIIMVHPKVRFHFSVKVNGILSTEIFGVENEPTLNLGNGIALLVDSQHYVSRPNFGTIESHCSRIHPVLGHPVMLFIPEDVAGMDLLGELILTPAAALCPSPKVSSNQLNRISSQLHIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 15654 - protein, 677 aa, Homo sapiens
  Payload ID: 3110
  Gene Symbol: C11orf80
  Gene Name: chromosome 11 open reading frame 80
  Uniprot ID: Q8N6T0
  ENSP ID: ENSP00000432039
MGSRCRAWAWTRAWALAEFQARAEEGAAAAAAAAGGYPSTGRCRCSLRGMEGTAVAVFEILRFLIIHWKCDIDVSKGALLEGQLVISIEGLNSKHQANALHCVTTRWSLTLLPRPECSGAVSAHCNLHLPGSSDSHASVPRVAGITDAHHHAWLIMVASAGSLFGGMVLKKFLKEIQSILPGISAKLTWTSEEGSYSQDMTGVTPFQMIFEVDEKPRTLMTDCLVIKHFLRKIIMVHPKVRFHFSVKVNGILSTEIFGVENEPTLNLGNGIALLVDSQHYVRPNFGTIESHCSRIHPVLGHPVMLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 15655 - protein, 108 aa, Homo sapiens
  Payload ID: 3110
  Gene Symbol: C11orf80
  Gene Name: chromosome 11 open reading frame 80
  ENSP ID: ENSP00000432775
  MOD_RES (1)..(1): Any amino acid
XIQSILPGISAKLTWTSEEGSYSQDMTGVTPFQMIFEVDEKPRTLMTDCLVIKHFLRKIIMVHPKVRFHFSVKVNGILSTEIFGVENEPTLNLGNGIALLVDSQHYVR

SEQ ID NO: 15656 - protein, 210 aa, Homo sapiens
  Payload ID: 3110
  Gene Symbol: C11orf80
  Gene Name: chromosome 11 open reading frame 80
  ENSP ID: ENSP00000433032
  MOD_RES (1)..(1): Any amino acid
XVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQLTLEKKDSAQGTEDAPDNSSLELLAVLKQPSQPTAAGVQQLSHSVTSRDARYQRASRKQEAQEGQPPHRGDASSALCQGPEPVRGRPAPPGSHRGPPHS

SEQ ID NO: 15657 - protein, 150 aa, Homo sapiens
  Payload ID: 3110
  Gene Symbol: C11orf80
  Gene Name: chromosome 11 open reading frame 80
  ENSP ID: ENSP00000433869
  MOD_RES (1)..(1): Any amino acid
XIQSILPGISAKLTWTSEEGSYSQDMTGVTPFQMIFEVDEKPRTLMTDCLVIKHFLRKIIMVHPKVRFHFSVKVNGILSTEIFGRPNFGTIESHCSRIHPVLGHPVMLFIPEDVAGMDLLGELILTPAAALCPSPKVSSNQLNRISSVSI

SEQ ID NO: 15658 - protein, 485 aa, Homo sapiens
  Payload ID: 3110
  Gene Symbol: C11orf80
  Gene Name: chromosome 11 open reading frame 80
  ENSP ID: ENSP00000434648
MVASAGSLFGGMVLKKFLKEIQSILPGISAKLTWTSEEGSYSQDMTGVTPFQMIFEVDEKPRTLMTDCLVIKHFLRKIIMVHPKVRFHFSVKVNGILSTEIFGVENEPTLNLGNGIALLVDSQHYVRPNFGTIESHCSRIHPVLGHPVMLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAADTQEFRTKLHKVFREITQHQFLHHCSCEVKQQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 15659 - protein, 459 aa, Homo sapiens
  Payload ID: 3110
  Gene Symbol: C11orf80
  Gene Name: chromosome 11 open reading frame 80
  ENSP ID: ENSP00000434804
MTDCLVIKHFLRKIIMVHPKVRFHFSVKVNGILSTEIFGVENEPTLNLGNGIALLVDSQHYVRPNFGTIESHCSRIHPVLGHPVMLFIPEDVAGMDLLGELILTPAAALCPSPKVSSNQLNRISSQLHIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 15660 - protein, 129 aa, Homo sapiens
  Payload ID: 3110
  Gene Symbol: C11orf80
  Gene Name: chromosome 11 open reading frame 80
  ENSP ID: ENSP00000434960
MTDCLVIKHFLRKIIMVHPKVRFHFSVKVNGILSTEIFGVENEPTLNLGNGIALLVDSQHYVSRPNFGTIESHCSRIHPVLGHPVMLFIPEDVAGMDLLGELILTPAAALCPSPKVSSNQLNRISSVSI

SEQ ID NO: 15661 - protein, 47 aa, Homo sapiens
  Payload ID: 3110
  Gene Symbol: C11orf80
  Gene Name: chromosome 11 open reading frame 80
  ENSP ID: ENSP00000435512
MVLKKFLKEIQSILPGISAKLTWTSEEGSYSQDMTGVTPFQMIFEAG

SEQ ID NO: 15662 - protein, 67 aa, Homo sapiens
  Payload ID: 3110
  Gene Symbol: C11orf80
  Gene Name: chromosome 11 open reading frame 80
  ENSP ID: ENSP00000437143
MVLKKFLKEIQSILPGISAKLTWTSEEGSYSQDMTGVTPFQMIFEVRFHFSVKVNGILSTEIFGVEN

SEQ ID NO: 15663 - protein, 15 aa, Homo sapiens
  Payload ID: 3110
  Gene Symbol: C11orf80
  Gene Name: chromosome 11 open reading frame 80
  ENSP ID: ENSP00000437319
MVASAGSLFGGMVLK

SEQ ID NO: 15664 - protein, 511 aa, Homo sapiens
  Payload ID: 3110
  Gene Symbol: C11orf80
  Gene Name: chromosome 11 open reading frame 80
  ENSP ID: ENSP00000444319
MVLKKFLKEIQSILPGISAKLTWTSEEGSYSQDMTGVTPFQMIFEVDEKPRTLMTDCLVIKHFLRKIIMVHPKVRFHFSVKVNGILSTEIFGVENEPTLNLGNGIALLVDSQHYVSRPNFGTIESHCSRIHPVLGHPVMLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 15665 - protein, 381 aa, Homo sapiens
  Payload ID: 3111
  Gene Symbol: C11orf84
  Gene Name: chromosome 11 open reading frame 84
  Uniprot ID: Q9BUA3
  ENSP ID: ENSP00000294244
MALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSDSGQDAHPDPDANPDAARMPAEIVVLLDSEDNPSLPKRSRPRGLRPLELPAVPATEPGNKKPRGQRWKEPPGEEPVRKKRGRPMTKNLDPDPEPPSPDSPTETFAAPAEVRHFTDGSFPAGFVLQLFSHTQLRGPDSKDSPKDREVAEGGLPRAESPSPAPPPGLRGTLDLQVIRVRMEEPPAVSLLQDWSRHPQGTKRVGAGDTSDWPTVLSESSTTVAGKPEKGNGV

SEQ ID NO: 15666 - protein, 29 aa, Homo sapiens
  Payload ID: 3111
  Gene Symbol: C11orf84
  Gene Name: chromosome 11 open reading frame 84
  ENSP ID: ENSP00000443715
  MOD_RES (1)..(1): Any amino acid
XKDREVAEGGLPRAESPSPGLTPSRRSQF

SEQ ID NO: 15667 - protein, 112 aa, Homo sapiens
  Payload ID: 3111
  Gene Symbol: C11orf84
  Gene Name: chromosome 11 open reading frame 84
  ENSP ID: ENSP00000445256
EPVRKKRGRPMTKNLDPDPEPPSPDSPTETFAAPAEVRHFTDGSFPAGFVLQLFSHTQLRGPDSKDSPKDREVAEGGLPRAESPSPGSPHFKSWGTLCANSIYLEWYIGWRQ

SEQ ID NO: 15668 - protein, 216 aa, Homo sapiens
  Payload ID: 3112
  Gene Symbol: C11orf85
  Gene Name: chromosome 11 open reading frame 85
  Uniprot ID: Q3KP22
  ENSP ID: ENSP00000301896
MSLKPFTYPFPETRFLHAGPNVYKFKIRYGKSIRGEEIENKEVITQELEDSVRVVLGNLDNLQPFATEHFIVFPYKSKWERVSHLKFKHGEIILIPYPFVFTLYVEMKWFHENLSPGKPISDSPLGLVPVEKKAVGAVMRKRKHMDEPSSPSRPGLDRIGKEKPNKDCRRLWPLISLMSRNKILSGDTACQGELSHPCSTTHLHLRSEQPPASLGF

SEQ ID NO: 15669 - protein, 216 aa, Homo sapiens; identical to SEQ ID NO: 15668
  Payload ID: 3112
  Gene Symbol: C11orf85
  Gene Name: chromosome 11 open reading frame 85
  Uniprot ID: Q3KP22
  ENSP ID: ENSP00000395273

SEQ ID NO: 15670 - protein, 114 aa, Homo sapiens
  Payload ID: 3112
  Gene Symbol: C11orf85
  Gene Name: chromosome 11 open reading frame 85
  ENSP ID: ENSP00000432213
MSLKPFTYPFPETRFLHAGPNVYKFKIRYGKSIRGEEIENKEVITQELEVGKEAYDFWKSYSLRMHPHSGFNYFLQTESQPPLDNLASSCYISFAKELYVFPWEFKACILSQFS

SEQ ID NO: 15671 - protein, 176 aa, Homo sapiens
  Payload ID: 3112
  Gene Symbol: C11orf85
  Gene Name: chromosome 11 open reading frame 85
  ENSP ID: ENSP00000434568
MSLKPFTYPFPETRFLHAGPNVYKFKIRYGKSIRGEEIENKEVITQELEVPVEKKAVGAVMRKRKHMDEPSSPSRPGLDRAKIGTSSQGPSKKKPPVETRRNRERKTQQGLQETLASDITDVQKQDSEWGHSLPGRIVPPLQHNSPPPKERAATGFFGFLSSLFPFRYFFRKSSHS

SEQ ID NO: 15672 - protein, 59 aa, Homo sapiens
  Payload ID: 3112
  Gene Symbol: C11orf85
  Gene Name: chromosome 11 open reading frame 85
  ENSP ID: ENSP00000435480
  MOD_RES (1)..(1): Any amino acid
XIGKEKPNKDCRRLWPLISLMSRNKILSGDTACQGELSHPCSTTHLHLRSEQPPASLGF

SEQ ID NO: 15673 - protein, 115 aa, Homo sapiens
  Payload ID: 3113
  Gene Symbol: C11orf86
  Gene Name: chromosome 11 open reading frame 86
  Uniprot ID: A6NJI1
  ENSP ID: ENSP00000311479
MGTGLRSQSLREPRPSYGKLQEPWGRPQEGQLRRALSLRQGQEKSRSQGLERGTEGPDATAQERVPGSLGDTEQLIQAQRRGSRWWLRRYQQVRRRWESFVAIFPSVTLSQPASP

SEQ ID NO: 15674 - protein, 197 aa, Homo sapiens
  Payload ID: 3114
  Gene Symbol: C11orf87
  Gene Name: chromosome 11 open reading frame 87
  Uniprot ID: Q6NUJ2
  ENSP ID: ENSP00000331581
MSARAPKELRLALPPCLLNRTFASPNASGSGNTGARGPGAVGSGTCITQVGQQLFQSFSSTLVLIVLVTLIFCLIVLSLSTFHIHKRRMKKRKMQRAQEEYERDHCSGSRGGGGLPRPGRQAPTHAKETRLERQPRDSPFCAPSNASSLSSSSPGLPCQGPCAPPPPPPASSPQGAHAASSCLDTAGEGLLQTVVLS

SEQ ID NO: 15675 - protein, 196 aa, Homo sapiens
  Payload ID: 3115
  Gene Symbol: C11orf88
  Gene Name: chromosome 11 open reading frame 88
  Uniprot ID: Q6PI97
  ENSP ID: ENSP00000333845
METGPSEEPSGRKESQEMCPPGLLVFAGSSEQDANLAKQFWISASMYPPSESQLVLRRDSSQRLPVARPRRSRGSENSHSSQSFHLASNKNRDIFAEALKIQESEEKVKYLQKTRSHSVTQNEVQWHDHGSLQPQLSRIQAKTREEILQLLRKQREERISKELISLPYKPKAKEHKAKKVVSESDKEDQEEVKTLD

SEQ ID NO: 15676 - protein, 169 aa, Homo sapiens
  Payload ID: 3115
  Gene Symbol: C11orf88
  Gene Name: chromosome 11 open reading frame 88
  Uniprot ID: Q6PI97
  ENSP ID: ENSP00000364768
METGPSEEPSGRKESQEMCPPGLLVFAGSSEQDANLAKQFWISASMYPPSESQLVLRRDSSQRLPVARPRRSRGSENSHSSQSFHLASNKNRDIFAEALKIQESEEKVKYLQKAKTREEILQLLRKQREERISKELISLPYKPKAKEHKAKKVVSESDKEDQEEVKTLD

SEQ ID NO: 15677 - protein, 178 aa, Homo sapiens
  Payload ID: 3115
  Gene Symbol: C11orf88
  Gene Name: chromosome 11 open reading frame 88
  ENSP ID: ENSP00000432911
METGPSEEPSGRKESQEMCPPGLLVFAGSSEQDANLAKQFWISASMYPPSESQLVLRRDSSQRLPVARPRRSRGSENSHSSQSFHLASNKNRDIFAEALKIQESEEKVKYLQKTRSHSVTQNEVQWHDHGSLQPQLSRIQAKTREEILQLLRKQREERISKELISLPYKPKAKEHKAK

SEQ ID NO: 15678 - protein, 29 aa, Homo sapiens
  Payload ID: 3115
  Gene Symbol: C11orf88
  Gene Name: chromosome 11 open reading frame 88
  ENSP ID: ENSP00000435029
NRDIFAEALKIQESEEKVKYLQKITGTIV

SEQ ID NO: 15679 - protein, 193 aa, Homo sapiens
  Payload ID: 3116
  Gene Symbol: C11orf91
  Gene Name: chromosome 11 open reading frame 91
  Uniprot ID: Q3C1V1
  ENSP ID: ENSP00000368296
MPKGRRGSHSPTMSQRSAPPLYFPSLYDRGISSSPLSDFNIWKKLFVPLKAGGAPVGGAAGARSLSQALPAPAPPPPPPPGLGPSSERPWPSPWPSGLASIPYEPLRFFYSPPPGPEVVASPLVPCPSTPRLASASHPEELCELEIRIKELELLTITGDGFDSQSYTFLKALKDEKLQGLKTKQPGKKSASLS

SEQ ID NO: 15680 - protein, 70 aa, Homo sapiens
  Payload ID: 3116
  Gene Symbol: C11orf91
  Gene Name: chromosome 11 open reading frame 91
  ENSP ID: ENSP00000433460
  MOD_RES (1)..(1): Any amino acid
XPEVVASPLVPCPSTPRLASASHPEELCELEIRIKELELLTITGDGFDSQSFLGLWTTCADAGRIPQPTS

SEQ ID NO: 15681 - protein, 98 aa, Homo sapiens
  Payload ID: 3117
  Gene Symbol: C11orf94
  Gene Name: chromosome 11 open reading frame 94
  Uniprot ID: C9JXX5
  ENSP ID: ENSP00000401498
MVLAMLGALHPRAGLSLFLHLILAVALLRSQPLRSQRSVPEAFSAPLELSQPLSGLVDDYGILPKHPRPRGPRPLLSRAQQRKRDGPDLAEYYYDAHL

SEQ ID NO: 15682 - protein, 276 aa, Homo sapiens
  Payload ID: 3118
  Gene Symbol: C11orf95
  Gene Name: chromosome 11 open reading frame 95
  ENSP ID: ENSP00000478462
  MOD_RES (1)..(1): Any amino acid
XNSWDAHLGLGACGEAEGLGVQGAEEEEEEEEEEEEEGAGVPACPPKGPGKAPAGGGCRRQRRGGPVAPRARRLRLSASRRAGGSRGLGARRLERRLKESLQNWFRAECLMDYDPRGNRLAWGGQPEALSELTQSPPGDDLAPQDLTGKSRDSASAAGAPSSQDLSPPDVKEEAGWVPERPGPAEEEEELEEGEGERAGVPGRSPRGRAHRRHPQERWRLEYLMELDGGRRGLVCGVCGGALASLKMSTIERHIRRRHPGSTRLGGPVQALIAREW

SEQ ID NO: 15683 - protein, 678 aa, Homo sapiens
  Payload ID: 3118
  Gene Symbol: C11orf95
  Gene Name: chromosome 11 open reading frame 95
  Uniprot ID: C9JLR9
  ENSP ID: ENSP00000482180
MEPGGDHRSRSSGGRGGPGPAVASARGRRLPPAGSSGSAEPEEDEGGQDLQLEGGALGSWGSAPLPSSRARGPASSGRKYSDHCEARASRPGKSRIPGRDHRRYYHDHWRLEYLMDFNPARHGMVCMVCGSSLATLKLSTIKRHIRQKHPYSLHWSPREKEVISNSWDAHLGLGACGEAEGLGVQGAEEEEEEEEEEEEEGAGVPACPPKGPGKAPAGGGCRRQRRGGPVAPRARRLRLSASRRAGGSRGLGARRLERRLKESLQNWFRAECLMDYDPRGNRLVCMACGRALPSLHLDDIRAHVLEVHPGSLGLSGPQRSALLQAWGGQPEALSELTQSPPGDDLAPQDLTGKSRDSASAAGAPSSQDLSPPDVKEEAGWVPERPGPAEEEEELEEGEGERAGVPGRSPRGRAHRRHPQERWRLEYLMELDGGRRGLVCGVCGGALASLKMSTIERHIRRRHPGSTRLGGPVQALIAREWSEKAAHLLALGPPRPESPQGPIPPGTAAASDEGGGDEEEEPEEEEEEWGDVPLSPGAPLERPAEEEEDEEDGQEPGGLALPPPPPPPPPPPPRSREQRRNYQPRWRGEYLMDYDGSRRGLVCMVCGGALATLKVSTIKRHILQVHPFSMDFTPEERQTILEAYEEAALRCYGHEGFGPPAPAPRDGGADLKSGAVCRA

SEQ ID NO: 15684 - protein, 47 aa, Homo sapiens
  Payload ID: 3118
  Gene Symbol: C11orf95
  Gene Name: chromosome 11 open reading frame 95
  ENSP ID: ENSP00000482857
MEPGGDHRSRSSGGRGGPGPAVASARGRRLPPAGSSGSAEPEEDEGD

SEQ ID NO: 15685 - protein, 202 aa, Homo sapiens
  Payload ID: 3118
  Gene Symbol: C11orf95
  Gene Name: chromosome 11 open reading frame 95
  ENSP ID: ENSP00000483097
  MOD_RES (1)..(1): Any amino acid
XVISNSWDAHLGLGACGEAEGLGVQGAEEEEEEEEEEEEEGAGVPACPPKGPGDVPLSPGAPLERPAEEEEDEEDGQEPGGLALPPPPPPPPPPPPRSREQRRNYQPRWRGEYLMDYDGSRRGLVCMVCGGALATLKVSTIKRHILQVHPFSMDFTPEERQTILEAYEEAALRCYGHEGFGPPAPAPRDGGADLKSGAVCRA

SEQ ID NO: 15686 - protein, 435 aa, Homo sapiens
  Payload ID: 3119
  Gene Symbol: C11orf96
  Gene Name: chromosome 11 open reading frame 96
  Uniprot ID: Q7Z7L8
  ENSP ID: ENSP00000340667
MGNKQPQKVTVPTGTALQGVVLIVSTLHQPGGWICGKDPCCSLRPLSNSVQNALACKSKQDYQAGILFKTRAFISRDCGSDAAEDSASKGETYTLTLEHKGAGEGDLRPRGQPGWCRLGDPRRDSARPVAAIEGPCPGAARASRVLRGRGFSRNPRGRGLPSGAGWRGAGGAGEGAVTFPERRGDVRRKGAGRARFKWHSLSSELRAVWAAAGYISREPGRRGADGDSSGGERLGARRNSAPRAPCPPTGPPARPPSRGAPARAREGRRHPAADLDPPPGEPPAAASRGAPAQRPPSESPGAPPPGPADAGGAMAAKPGELMGICSSYQAVMPHFVCLADEFPQPVRPAKLPKGRGRLRRPRQSRFKTQPVTFDEIQEVEEEGVSPMEEEKAKKSFLQSLECLRRSTQSLSLQREQLSSCKLRNSLDSSDSDSAL

SEQ ID NO: 15687 - protein, 417 aa, Homo sapiens [sequence omitted]

SEQ ID NO: 15688 - protein, 122 aa, Homo sapiens
  Payload ID: 3119
  Gene Symbol: C11orf96
  Gene Name: chromosome 11 open reading frame 96
  ENSP ID: ENSP00000479976
MAAKPGELMGICSSYQAVMPHFVCLADEFPQPVRPAKLPKGRGRLRRPRQSRFKTQPVTFDEIQEVEEEGVSPMEEEKAKKSFLQSLECLRRSTQSLSLQREQLSSCKLRNSLDSSDSDSAL

SEQ ID NO: 15689 - protein, 122 aa, Homo sapiens
  Payload ID: 3120
  Gene Symbol: C11orf98
  Gene Name: chromosome 11 open reading frame 98
  Uniprot ID: E9PRG8
  ENSP ID: ENSP00000432316
MGAPGGKINRPRTELKKKLFKRRRVLNRERRLRHRVVGAVIDQGLITRHHLKKRASSARANITLSGKKRRKLLQQIRLAQKEKTAMEGEAGTEVGEGNPGFIWDNTSFFPLLSGSPFKASQD

SEQ ID NO: 15690 - protein, 123 aa, Homo sapiens
  Payload ID: 3120
  Gene Symbol: C11orf98
  Gene Name: chromosome 11 open reading frame 98
  ENSP ID: ENSP00000432523
MGAPGGKINRPRTELKKKLFKRRRVLNRERRLRHRVVGAVIDQGLITRHHLKKRASSARANITLSGKKRRKLLQQIRLAQKEKTAMEVEAPSKPARTSEPQLKRQKKTKAPQDVEMKDLEDES

SEQ ID NO: 15691 - protein, 376 aa, Homo sapiens
  Payload ID: 3121
  Gene Symbol: C12orf10
  Gene Name: chromosome 12 open reading frame 10
  Uniprot ID: Q9HB07
  ENSP ID: ENSP00000267103
MGHQFLRGLLTLLLPPPPLYTRHRMLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGTSEEDSMVGTLYDKMYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFTGGHHTREGALSMARATLAQRSYLPQIS

SEQ ID NO: 15692 - protein, 213 aa, Homo sapiens
  Payload ID: 3121
  Gene Symbol: C12orf10
  Gene Name: chromosome 12 open reading frame 10
  ENSP ID: ENSP00000448433
MYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFTGGHHTREGALSMARATLAQRSYLPQIS

SEQ ID NO: 15693 - protein, 301 aa, Homo sapiens
  Payload ID: 3121
  Gene Symbol: C12orf10
  Gene Name: chromosome 12 open reading frame 10
  ENSP ID: ENSP00000450270
MLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGTSEEDSMVGTLYDKAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFTGGHHTREGALSMARATLAQRSYLPQIS

SEQ ID NO: 15694 - protein, 130 aa, Homo sapiens
  Payload ID: 3121
  Gene Symbol: C12orf10
  Gene Name: chromosome 12 open reading frame 10
  ENSP ID: ENSP00000455319
  MOD_RES (1)..(1): Any amino acid
XMVGTLYDKVDPSGEIVELAKGACPWKEHLYHLESGLSPPVAIFFVIYTDQAGQWRIQCVPKEPHSFQSRLPLPEPWRGLRDEALDQVSGIPGCIFVHASGFTGGHHTREGALSMARATLAQRSYLPQIS

SEQ ID NO: 15695 - protein, 325 aa, Homo sapiens
  Payload ID: 3122
  Gene Symbol: C12orf29
  Gene Name: chromosome 12 open reading frame 29
  Uniprot ID: Q8N999
  ENSP ID: ENSP00000349358
MKRLGSVQRKMPCVFVTEVKEEPSSKREHQPFKVLATETVSHKALDADIYSAIPTEKVDGTCCYVTTYKDQPYLWARLDRKPNKQAEKRFKNFLHSKENPKEFFWNVEEDFKPAPECWIPAKETEQINGNPVPDENGHIPGWVPVEKNNKQYCWHSSVVNYEFEIALVLKHHPDDSGLLEISAVPLSDLLEQTLELIGTNINGNPYGLGSKKHPLHLLIPHGAFQIRNLPSLKHNDLVSWFEDCKEGKIEGIVWHCSDGCLIKVHRHHLGLCWPIPDTYMNSRPVIINMNLNKCDSAFDIKCLFNHFLKIDNQKFVRLKDIIFDV

SEQ ID NO: 15696 - protein, 38 aa, Homo sapiens
  Payload ID: 3122
  Gene Symbol: C12orf29
  Gene Name: chromosome 12 open reading frame 29
  Uniprot ID: Q8N999
  ENSP ID: ENSP00000402018
MKRLGSVQRKMPCVFVTEVKEEPSSKREHQISHTFGLD

SEQ ID NO: 15697 - protein, 38 aa, Homo sapiens; identical to SEQ ID NO: 15696
  Payload ID: 3122
  Gene Symbol: C12orf29
  Gene Name: chromosome 12 open reading frame 29
  Uniprot ID: Q8N999
  ENSP ID: ENSP00000447327

SEQ ID NO: 15698 - protein, 38 aa, Homo sapiens; identical to SEQ ID NO: 15696
  Payload ID: 3122
  Gene Symbol: C12orf29
  Gene Name: chromosome 12 open reading frame 29
  Uniprot ID: Q8N999
  ENSP ID: ENSP00000448194

SEQ ID NO: 15699 - protein, 50 aa, Homo sapiens
  Payload ID: 3122
  Gene Symbol: C12orf29
  Gene Name: chromosome 12 open reading frame 29
  ENSP ID: ENSP00000448332
MKRLGSVQRKMPCVFVTEVKEEPSSKREHQVSTFWGNPLISHLKFWQLKL

SEQ ID NO: 15700 - protein, 552 aa, Homo sapiens
  Payload ID: 3123
  Gene Symbol: C12orf4
  Gene Name: chromosome 12 open reading frame 4
  Uniprot ID: Q9NQ89
  ENSP ID: ENSP00000261250
MKKNRERFCNREREFVYKFKVGSQCLELRVPLKFPVQENASHLHGRLMLLHSLPCFIEKDLKEALTQFIEEESLSDYDRDAEASLAAVKSGEVDLHQLASTWAKAYAETTLEHARPEEPSWDEDFADVYHDLIHSPASETLLNLEHNYFVSISELIGERDVELKKLRERQGIEMEKVMQELGKSLTDQDVNSLAAQHFESQQDLENKWSNELKQSTAIQKQEYQEWVIKLHQDLKNPNNSSLSEEIKVQPSQFRESVEAIGRIYEEQRKLEESFTIHLGAQLKTMHNLRLLRADMLDFCKHKRNHRSGVKLHRLQTALSLYSTSLCGLVLLVDNRINSYSGIKRDFATVCQECTDFHFPRIEEQLEVVQQVVLYARTQRRSKLKESLDSGNQNGGNDDKTKNAERNYLNVLPGEFYITRHSNLSEIHVAFHLCVDDHVKSGNITARDPAIMGLRNILKVCCTHDITTISIPLLLVHDMSEEMTIPWCLRRAELVFKCVKGFMMEMASWDGGISRTVQFLVPQSISEEMFYQLSNMLPQIFRVSSTLTLTSKH

SEQ ID NO: 15701 - protein, 77 aa, Homo sapiens
  Payload ID: 3123
  Gene Symbol: C12orf4
  Gene Name: chromosome 12 open reading frame 4
  ENSP ID: ENSP00000439471
MEKVMQELGKSLTDQDVNSLAAQHFESQQDLENKWSNELKQSTAIQKQEYQEWVIKLHQDLKNPNNSSLRSPVEDHA

SEQ ID NO: 15702 - protein, 552 aa, Homo sapiens; identical to SEQ ID NO: 15700
  Payload ID: 3123
  Gene Symbol: C12orf4
  Gene Name: chromosome 12 open reading frame 4
  Uniprot ID: Q9NQ89
  ENSP ID: ENSP00000439996

SEQ ID NO: 15703 - protein, 204 aa, Homo sapiens
  Payload ID: 3123
  Gene Symbol: C12orf4
  Gene Name: chromosome 12 open reading frame 4
  ENSP ID: ENSP00000440820
MEKVMQELGKSLTDQDVNSLAAQHFESQQDLENKWSNELKQSTAIQKQEYQEWVIKLHQDLKNPNNSSLSEEIKVQPSQFRESVEAIGRIYEEQRKLEESFTIHLGAQLKTMHNLRLLRADMLDFCKHKRNHRSGVKLHRLQTALSLYSTSLCGLVLLVDNRINSYSGIKRDFATVCQECTDFHFPRIEEQLEVVQQVVLYART

SEQ ID NO: 15704 - protein, 144 aa, Homo sapiens
  Payload ID: 3123
  Gene Symbol: C12orf4
  Gene Name: chromosome 12 open reading frame 4
  ENSP ID: ENSP00000442806
MLLHSLPCFIEKDLKEALTQFIEEESLSDYDRDAEASLAAVKSGEVDLHQLASTWAKAYAETTLEHARPEEPSWDEDFADVYHDLIHSPASETLLNLEHNYFVSISELIGERDVELKKLRERQGIEMEKVMQELGKSLTDQDVN

SEQ ID NO: 15705 - protein, 47 aa, Homo sapiens
  Payload ID: 3123
  Gene Symbol: C12orf4
  Gene Name: chromosome 12 open reading frame 4
  ENSP ID: ENSP00000444594
LYARTQRRSKLKESLDSGNQNGGNDDKTKNAERNYLNVLPGTTENTS

SEQ ID NO: 15706 - protein, 652 aa, Homo sapiens
  Payload ID: 3124
  Gene Symbol: C12orf40
  Gene Name: chromosome 12 open reading frame 40
  Uniprot ID: Q86WS4
  ENSP ID: ENSP00000317671
MNWVGGSRSRVLIKQERRKQKEYFEKHRLKSKMKSLGVLSPVKNSAVSLDILNLYMVNQISCKKKIPETVRKPTHVNMNRDIKMPLRKHNLELTMSPHCVPSKLCLDDTETNVNCQRLSSKEDLGPVQSQGMDSYSMLHPQFSKIENCSFTPSSFSVELPSNRHISKLNFTSGIAPTPQKLAYEKKQNDQRSTVNCSDSLLSKLNKSQDVFSPSHKTTRFGTLFERLNSLGNRNLLTKSPAVIMDEDCRSTDEIRQSDYITEKHSIQHIWGKNGKEVSNFLEDVNQSTPNLLSENCDSFVSQNMINVLNIDEQRIKKTFNKCDYDSMGDTCVVTSSDKNHVTDRCIRNIFTVPELTFSNSTLNKTSYPEKCQPNKKYQREYNKNERNDLSTSFENDYYPSSSERKEKFENDYQEKTPQKSIQKYPANSMGNIPSEELHSKQSWDFGLDEILMEEGGIYSLKSKRISTKKISLDSAQSSRSTSYSPRPTDSCFSSSSDLPSEDEDQISQQIEDSNRMTIKTKEKMNNFYVERMAKLSGDRIVKNDDKIHKQNENFYQFSVKNNTDQFPQLQCNSAHILQNKTNDNCVLQAARCDAGIQTESESVMEEKLDVAIQCDLISKCTCRSDVSLCNLERCSGNIKADTTGGQEIHKNN

SEQ ID NO: 15707 - protein, 477 aa, Homo sapiens
  Payload ID: 3124
  Gene Symbol: C12orf40
  Gene Name: chromosome 12 open reading frame 40
  Uniprot ID: Q86WS4
  ENSP ID: ENSP00000383897
MNWVGGSRSRVLIKQERRKQKEYFEKHRLKSKMKSLGVLSPVKNSAVSLDILNLYMVNQISCKKKIPETVRKPTHVNMNRDIKMPLRKHNLELTMSPHCVPSKLCLDDTETNVNCQRLSSKEDLGPVQSQGMDSYSMLHPQFSKIENCSFTPSSFSVELPSNRHISKLNFTSGIAPTPQKLAYEKKQNDQRSTVNCSDSLLSKLNKSQDVFSPSHKTTRFGTLFERLNSLGNRNLLTKSPAVIMDEDCRSTDEIRQSDYITEKHSIQHIWGKNGKEVSNFLEDVNQSTPNLLSENCDSFVSQNMINVLNIDEQRIKKTFNKCDYDSMGDTCVVTSSDKNHVTDRCIRNIFTVPELTFSNSTLNKTSYPEKCQPNKKYQREYNKNERNDLSTSFENDYYPSSSERKEKFENDYQEKTPQKSIQKYPANSMGNIPSEELHSKQSWDFGLDEILMEEGGIYSLKSKRISTKKICQYNCIS

SEQ ID NO: 15708 - protein, 394 aa, Homo sapiens
  Payload ID: 3124
  Gene Symbol: C12orf40
  Gene Name: chromosome 12 open reading frame 40
  Uniprot ID: Q86WS4
  ENSP ID: ENSP00000473371
MNRDIKMPLRKHNLELTMSPHCVPSKLCLDDTETNVNCQRLSSKEDLGPVQSQGMDSYSMLHPQFSKIENCSFTPSSFSVELPSNRHISKLNFTSGIAPTPQKLAYEKKQNDQRSTVNCSDSLLSKLNKSQDVFSPSHKTTRFGTLFERLNSLGNRNLLTKSPAVIMDEDCRSTDEIRQSDYITEKHSIQHIWGKNGKEVSNFLEDVNQSTPNLLSENCDSFVSQNMINVLNIDEQRIKKTFNKCDYDSMGDTCVVTSSDKNHVTDRCIRNIFTVPELTFSNSTLNKTSYPEKCQPNKKYQREYNKNERNDLSTSFENDYYPSSSERKEKFENDYQEKTPQKSIQKYPANSIWCTKCSEFKVIFTLIHYVLMLNLFLKSLRTAFQAFLNNDLQL

SEQ ID NO: 15709 - protein, 360 aa, Homo sapiens
  Payload ID: 3125
  Gene Symbol: C12orf42
  Gene Name: chromosome 12 open reading frame 42
  Uniprot ID: Q96LP6
  ENSP ID: ENSP00000367353
MSTVICMKQREEEFLLTIRPFANRMQKSPCYIPIVSSATLWDRSTPSAKHIPCYERTSVPCSRFINHMKNFSESPKFRSLHFLNFPVFPERTQNSMACKRLLHTCQYIVPRCSVSTVSFDEESYEEFRSSPAPSSETDEAPLIFTARGETEERARGAPKQAWNSSFLEQLVKKPNWAHSVNPVHLEAQGIHISRHTRPKGQPLSSPKKNSGSAARPSTAIGLCRRSQTPGALQSTGPSNTELEPEERMAVPAGAQAHPDDIQSRLLGASGNPVGKGAVAMAPEMLPKHPHTPRDRRPQADTSLHGNLAGAPLPLLAGASTHFPSKRLIKVCSSAPPRPTRRFHTVCSQALSRPVVNAHLH

SEQ ID NO: 15710 - protein, 107 aa, Homo sapiens
  Payload ID: 3125
  Gene Symbol: C12orf42
  Gene Name: chromosome 12 open reading frame 42
  Uniprot ID: Q96LP6
  ENSP ID: ENSP00000446908
MSTVICMKQREEEFLLTIRPFANRMQKSPCYIPIVSSATLWDRSTPSAKHIPCYERTSVPCSRFINHMKNFSESPKFRSLHFLNFPGSHHGQATQKLQGAMVLHLEE

SEQ ID NO: 15711 - protein, 207 aa, Homo sapiens
  Payload ID: 3125
  Gene Symbol: C12orf42
  Gene Name: chromosome 12 open reading frame 42
  ENSP ID: ENSP00000447795
MSTVICMKQREEEFLLTIRPFANRMQKSPCYIPIVSSATLWDRSTPSAKHIPCYERTSVPCSRFINHMKNFSESPKFRSLHFLNFPVFPERTQNSMACKRLLHTCQYIVPRCSVSTVSFDEESYEEFRSSPAPSSETDEAPLIFTARGETEERARGAPKQAWNSSFLEQLVKKPNWAHSVNPVHLEAQGIHISRHTRPKGQPLSSPK

SEQ ID NO: 15712 - protein, 360 aa, Homo sapiens; identical to SEQ ID NO: 15709
  Payload ID: 3125
  Gene Symbol: C12orf42
  Gene Name: chromosome 12 open reading frame 42
  Uniprot ID: Q96LP6
  ENSP ID: ENSP00000447908

SEQ ID NO: 15713 - protein, 293 aa, Homo sapiens
  Payload ID: 3125
  Gene Symbol: C12orf42
  Gene Name: chromosome 12 open reading frame 42
  ENSP ID: ENSP00000449362
MKNFSESPKFRSLHFLNFPVFPERTQNSMACKRLLHTCQYIVPRCSVSTVSFDEESYEEFRSSPAPSSETDEAPLIFTARGETEERARGAPKQAWNSSFLEQLVKKPNWAHSVNPVHLEAQGIHISRHTRPKGQPLSSPKKNSGSAARPSTAIGLCRRSQTPGALQSTGPSNTELEPEERMAVPAGAQAHPDDIQSRLLGASGNPVGKGAVAMAPEMLPKHPHTPRDRRPQADTSLHGNLAGAPLPLLAGASTHFPSKRLIKVCSSAPPRPTRRFHTVCSQALSRPVVNAHLH

SEQ ID NO: 15714 - protein, 90 aa, Homo sapiens
  Payload ID: 3125
  Gene Symbol: C12orf42
  Gene Name: chromosome 12 open reading frame 42
  ENSP ID: ENSP00000449447
MSTVICMKQREEEFLLTIRPFANRMQKSPCYIPIVSSATLWDRSTPSAKHIPCYERTSVPCSRFINHMKNFSESPKFRSLHFLNFPGPFH

SEQ ID NO: 15715 - protein, 262 aa, Homo sapiens
  Payload ID: 3126
  Gene Symbol: C12orf43
  Gene Name: chromosome 12 open reading frame 43
  Uniprot ID: Q96C57
  ENSP ID: ENSP00000288757
MAAPSGTVSDSESSNSSSDAEELERCREAAMPAWGLEQRPHVAGKPRAGAANSQLSTSQPSLRHKVNEHEQDGNELQTTPEFRAHVAKKLGALLDSFITISEAAKEPAKAKVQKVALEDDGFRLFFTSVPGGREKEESPQPRRKRQPSSSSEDSDEEWRRCREAAVSASDILQESAIHSPGTVEKEAKKKRKLKKKAKKVASVDSAVAATTPTSMATVQKQKSGELNGDQVSLGTKKKKKAKKASETSPFPPAKSATAIPAN

SEQ ID NO: 15716 - protein, 221 aa, Homo sapiens
  Payload ID: 3126
  Gene Symbol: C12orf43
  Gene Name: chromosome 12 open reading frame 43
  ENSP ID: ENSP00000409788
MFCQNPGAANSQLSTSQPSLRHKVNEHEQDGNELQTTPEFRAHVAKKLGALLDSFITISEAAKEPAKAKVQKVALEDDGFRLFFTSVPGGREKEESPQPRRKRQPSSSSSEDSDEEWRRCREAAVSASDILQESAIHSPGTVEKEAKKKRKLKKKAKKVASVDSAVAATTPTSMATVQKQKSGELNGDQVSLGTKKKKKAKKASETSPFPPAKSATAIPAN

SEQ ID NO: 15717 - protein, 252 aa, Homo sapiens
  Payload ID: 3126
  Gene Symbol: C12orf43
  Gene Name: chromosome 12 open reading frame 43
  ENSP ID: ENSP00000437803
MAAPSGTVSDSESSNSSSDAEELERCREAAMPAWGLEQRPHVAGKPRAGAANSQLSTSQPSLRHKVNEHEQDGNELQTTPEFRAHVAKKLGALLDSFITISEAAKEPAKAKVQKVALEDDGREKEESPQPRRKRQPSSSSSEDSDEEWRRCREAAVSASDILQESAIHSPGTVEKEAKKKRKLKKKAKKVASVDSAVAATTPTSMATVQKQKSGELNGDQVSLGTKKKKKAKKASETSPFPPAKSATAIPAN

SEQ ID NO: 15718 - protein, 188 aa, Homo sapiens
  Payload ID: 3126
  Gene Symbol: C12orf43
  Gene Name: chromosome 12 open reading frame 43
  ENSP ID: ENSP00000438856
MDGAANSQLSTSQPSLRHKVNEHEQDGNELQTTPEFRAHVAKKLGALLDSFITISEAAKEPAKAKVQKVALEDDGFRLFFTSVPGGREKEESPQPRRKRQPSSSSSEDSDEEWRRCREAAVSASDILQESAIHSPGTVEKEAKKKRKLKKKAKKVASVDSAVAATTPTSMATVQKQKSGELNGDQVSL

SEQ ID NO: 15719 - protein, 195 aa, Homo sapiens
  Payload ID: 3126
  Gene Symbol: C12orf43
  Gene Name: chromosome 12 open reading frame 43
  ENSP ID: ENSP00000442041
SSSDAEELERCREAAMPAWGLEQRPHVAGKPRAGAANSQLSTSQPSLSFITISEAAKEPAKAKVQKVALEDDGFRLFFTSVPGGREKEESPQPRRKRQPSSSSSEDSDEEWRRCREAAVSASDILQESAIHSPGTVEKEAKKKRKLKKKAKKVASVDSAVAATTPTSMATVQKQKSGELNGDQVSLGTKKKKKAK

SEQ ID NO: 15720 - protein, 293 aa, Homo sapiens
  Payload ID: 3126
  Gene Symbol: C12orf43
  Gene Name: chromosome 12 open reading frame 43
  ENSP ID: ENSP00000442224
MAAPSGTVSDSESSNSSSDAEELERCREAAMPAWGLEQRPHVAGKPRAGAANSQLSTSQPSLRYYALWVQVSLIQQILIPCVCQMLGFTPGISRHKVNEHEQDGNELQTTPEFRAHVAKKLGALLDSFITISEAAKEPAKAKVQKVALEDDGFRLFFTSVPGGREKEESPQPRRKRQPSSSSEDSDEEWRRCREAAVSASDILQESAIHSPGTVEKEAKKKRKLKKKAKKVASVDSAVAATTPTSMATVQKQKSGELNGDQVSLGTKKKKKAKKASETSPFPPAKSATAIPAN

SEQ ID NO: 15721 - protein, 66 aa, Homo sapiens
  Payload ID: 3126
  Gene Symbol: C12orf43
  Gene Name: chromosome 12 open reading frame 43
  ENSP ID: ENSP00000443642
MAAPSGTVSDSESSNSSSDAEELERCREAAMPAWGLEQRPHVAGKPRAVEMGFHHVDQDGLDLLTS

SEQ ID NO: 15722 - protein, 67 aa, Homo sapiens
  Payload ID: 3127
  Gene Symbol: C12orf45
  Gene Name: chromosome 12 open reading frame 45
  ENSP ID: ENSP00000280749
MEVHGKPKASPSCSSPTRDSSGVPVSKELLTAGSDGRGGIWDRLLINSQPKSRKTSTLQTVRIERSP

SEQ ID NO: 15723 - protein, 185 aa, Homo sapiens
  Payload ID: 3127
  Gene Symbol: C12orf45
  Gene Name: chromosome 12 open reading frame 45
  Uniprot ID: Q8N5I9
  ENSP ID: ENSP00000447057
MEVHGKPKASPSCSSPTRDSSGVPVSKELLTAGSDGRGGIWDRLLINSQPKSRKTSTLQTVRIERSPLLDQVQTFLPQMARANEKLRKEMAAAPPGRFNIENIDGPHSKVIQMDVALFEMNQSDSKEVDSSEESSQDSSENSSESEDEDDSIPSEVTIDNIKLPNSEGGKGKIEVLDSPASKKKK

SEQ ID NO: 15724 - protein, 187 aa, Homo sapiens
  Payload ID: 3127
  Gene Symbol: C12orf45
  Gene Name: chromosome 12 open reading frame 45
  ENSP ID: ENSP00000477543
MEVHGKPKASPSCSSPTRDSSGVPVSKELLTAGSDGRGGIWDRLLINSQPKSRKTSTLQTVRIERSPLLDQVQTFLPQMARANEKLRKEMAAAPPGRFNIENIDGPHSKVIQMDVALFEMNQSDSKEVDSSEESSQDSSENSSESEDEDDSIPSEVTIDNIKLPNSEGGKGKIEVLDSPASKKEIVK

SEQ ID NO: 15725 - protein, 205 aa, Homo sapiens
  Payload ID: 3128
  Gene Symbol: C12orf49
  Gene Name: chromosome 12 open reading frame 49
  Uniprot ID: Q9H741
  ENSP ID: ENSP00000261318
MVNLAAMVWRRLLRKRWVLALVFGLSLVYFLSSTFKQEERAVRDRNLLQVHDHNQPIPWKVQFNLGNSSRPSNQCRNSIQGKHLITDELGYVCERKDLLVNGCCNVNVPSTKQYCCDGCWPNGCCSAYEYCVSCCLQPNKQLLLERFLNRAAVAFQNLFMAVEDHFELCLAKCRTSSQSVQHENTYRDPIAKYCYGESPPELFPA

SEQ ID NO: 15726 - protein, 47 aa, Homo sapiens
  Payload ID: 3128
  Gene Symbol: C12orf49
  Gene Name: chromosome 12 open reading frame 49
  ENSP ID: ENSP00000446478
MVNLAAMVWRRLLRKRWVLALVFGLSLVYFLSSTFKQATFARGRICW

SEQ ID NO: 15727 - protein, 43 aa, Homo sapiens
  Payload ID: 3128
  Gene Symbol: C12orf49
  Gene Name: chromosome 12 open reading frame 49
  ENSP ID: ENSP00000447722
  MOD_RES (1)..(1): Any amino acid
XFGLSLVYFLSSTFKQSVQHENTYRDPIAKYCYGESPPELFPA

SEQ ID NO: 15728 - protein, 46 aa, Homo sapiens
  Payload ID: 3128
  Gene Symbol: C12orf49
  Gene Name: chromosome 12 open reading frame 49
  ENSP ID: ENSP00000449151
MAVEDHFELCLAKCRTSSQSVQHENTYRDPIAKYCYGESPPELFPA

SEQ ID NO: 15729 - protein, 414 aa, Homo sapiens
  Payload ID: 3129
  Gene Symbol: C12orf50
  Gene Name: chromosome 12 open reading frame 50
  Uniprot ID: Q8NA57
  ENSP ID: ENSP00000298699
MEMQQNCSISCFWETQPLGCVKISCIFYHSKPRNINGLFLPPSSNITLQKEIQEGIPLQSQSQEPLKPQENISRPIHHPLVLKTNFEEEEEVDEQNDASSLWTKTPEEIEEKRAIKEMCYKSGEYYRFHTPPDILSSKSMTPTAEKQLEKPLENGSELQEGDSLTVPTKLSQYERQGEIKTSLHGKPKTDIAAFENGGGDCYVPQRVIFLGVDESEALTEEKEITISKCSNTKDNKDSPHPKHSLTTRLVPTTHVLNATENISMKCREDPSSMNDVQPVKKPHFKGVKKRKWIYDEPQNFPNSGMQRAVQAPRPQNKMSYHRNNKNRNAENASYIHVQRDAVRTVALNAPSRSRPTHGSYNKVHANREPKPNLSPDKYTSTSYNDSAWRKRIPFSKTYSKSEKIYPEPRRNGSK

SEQ ID NO: 15730 - protein, 375 aa, Homo sapiens
  Payload ID: 3129
  Gene Symbol: C12orf50
  Gene Name: chromosome 12 open reading frame 50
  ENSP ID: ENSP00000448344
MEMQQNCSISCFWETQPLGCVKISCIFYHSKPRNINGLFLPPSSNITLQKEIQEGIPLQSQSQEPLKPQENISRPIHHPLVLKTNFEEEEEVDEQNDASSLWTKTPEEIEEKRAIKEMCYKSGEYYRFHTPPDILSSKSMTPTAEKQLEKPLENGSELQEGDSLTVPTKLSQYERQGEIKTSLHGKPKTDIAAFENGGGDCYVPQRVIFLGVDESEALTEEKEITISKCSNTKVNDVQPVKKPHFKGVKKRKWIYDEPQNFPNSGMQRAVQAPRPQNKMSYHRNNKNRNAENASYIHVQRDAVRTVALNAPSRSRPTHGSYNKVHANREPKPNLSPDKYTSTSYNDSAWRKRIPFSKTYSKSEKIYPEPRRNGSK

SEQ ID NO: 15731 - protein, 96 aa, Homo sapiens
  Payload ID: 3129
  Gene Symbol: C12orf50
  Gene Name: chromosome 12 open reading frame 50
  ENSP ID: ENSP00000448855
MEMQQNCSISCFWETQPLGCVKISCIFYHSKPRNINGLFLPPSSNITLQKEIQEGIPLQSQSQEPLKPQENISRPIHHPLVLKTNFEEEEEVDEQN

SEQ ID NO: 15732 - protein, 127 aa, Homo sapiens
  Payload ID: 3130
  Gene Symbol: C12orf54
  Gene Name: chromosome 12 open reading frame 54
  Uniprot ID: Q6X4T0
  ENSP ID: ENSP00000316898
MAQHPCQDQEQKVEMTSKQQRSTSIEETMRPQEKQVTITETLWDQVLTVFKDIQKELQEDARIRGMSNCSMTPMTSAPRTGSIRPPDSLMTPKLRRLQFSSGEQPSGGRIHNLKTQLFSQSAYYPGP

SEQ ID NO: 15733 - protein, 101 aa, Homo sapiens
  Payload ID: 3130
  Gene Symbol: C12orf54
  Gene Name: chromosome 12 open reading frame 54
  ENSP ID: ENSP00000369859
MAQHPCQDQEQKVEMTSKQQRSTSIEETMRPQEKQVTITETLWDQVLTVFKDIQKESTTDLSVQAAKARRCLTVPLRKCDNTNRKLYLLELVSARILYVVV

SEQ ID NO: 15734 - protein, 127 aa, Homo sapiens; identical to SEQ ID NO: 15732
  Payload ID: 3130
  Gene Symbol: C12orf54
  Gene Name: chromosome 12 open reading frame 54
  Uniprot ID: Q6X4T0
  ENSP ID: ENSP00000447109

SEQ ID NO: 15735 - protein, 71 aa, Homo sapiens
  Payload ID: 3130
  Gene Symbol: C12orf54
  Gene Name: chromosome 12 open reading frame 54
  ENSP ID: ENSP00000450103
LQEDARIRGMSNCSMTPMTSAPRTGSIRPPDSLMTPKLRRLQFSSGEQPSGGRIHNLKTQLFSQSAYYPGP

SEQ ID NO: 15736 - protein, 462 aa, Homo sapiens
  Payload ID: 3131
  Gene Symbol: C12orf56
  Gene Name: chromosome 12 open reading frame 56
  Uniprot ID: Q8IXR9
  ENSP ID: ENSP00000329698
MASPLPSGFPARRNSRLDVFLRRHLPPEVYDAVRAYEPCIVVSNSENHILKYVVLSDRLVYLTENPPKSIRRVVALRDVVAIDLIDDYPEFLSSPDREISQHIRIIYSSTVLKKECKKSNSVRKFLFPFHHTKANNKKVKEEKNGLAFWRSKESRSLKESPLRSEEKIKHFSQLKSELFLKDNSLRRILSLLMELKVAAQKNFILKRLFWKTSDLFYFIVNKLHEYLPESRDKNALQNQSQRVDELVACIEIIQTLVLMFRETETESSRLNTLAAKKGALFNLLVILISEPQIPKSCPVFDIQLVADSALVRMSFDAELQKLILEYTNTATALLYEILLVFQQGNLGLGSTKFAISWIMSFLQSCPPIITFVASIVKQVVRGLSASFQLLSPCQAVLLYQQFYILKSCLRHSRTLAEYIRNNYREEFRYFIHMPALQKRLPLCYPITQPTIQLFHEVLKLVE

SEQ ID NO: 15737 - protein, 184 aa, Homo sapiens
  Payload ID: 3131
  Gene Symbol: C12orf56
  Gene Name: chromosome 12 open reading frame 56
  ENSP ID: ENSP00000443341
NSRLDVFLRRHLPPEVYDAVRAYEPCIVVSNSENHILKYVVLSDRLVYLTENPPKSIRRVVALRDVVAIDLIDDYPEFLSSPDREISQHIRIIYSSTVLKKECKKSNSVRKFLFPFHHTKANNKKVKEEKNGLAFWRSKESRSLKESPLRKLLFYKIPSMLVSSVLLLEVKSHIGLRRKLSTSV

SEQ ID NO: 15738 - protein, 622 aa, Homo sapiens
  Payload ID: 3131
  Gene Symbol: C12orf56
  Gene Name: chromosome 12 open reading frame 56
  Uniprot ID: Q8IXR9
  ENSP ID: ENSP00000446101
MASPLPSGFPARRNSRLDVFLRRHLPPEVYDAVRAYEPCIVVSNSENHILKYVVLSDRLVYLTENPPKSIRRVVALRDVVAIDLIDDYPEFLSSPDREISQHIRIIYSSTVLKKECKKSNSVRKFLFPFHHTKANNKKVKEEKNGLAFWRSKESRSLKESPLRDQQESSTPSKDSTLCPRPGLKKLSLHGQGAFRPLPSPSRRSSQSAPTTGKAVSEPSCTTNTKEPQGLPDHNSISEIPFKCNGNGNEFYLGNSLLDSPSQSNSNLEKKESELHLYVISTTSSIFLHLKSSWNNYIIKATLLQDPFYASEFSPAIGSQKPYRSEEKIKHFSQLKSELFLKDNSLRRILSLLMELKVAAQKNFILKRLFWKTSDLFYFIVNKLHEYLPESRDKNALQNQSQRVDELVACIEIIQTLVLMFRETETESSRLNTLAAKKGALFNLLVILISEPQIPKSCPVFDIQLVADSALVRMSFDAELQKLILEYTNTATALLYEILLVFQQGNLGLGSTKFAISWIMSFLQSCPPIITFVASIVKQVVRGLSASFQLLSPCQAVLLYQQFYILKSCLRHSRTLAEYIRNNYREEFRYFIHMPALQKRLPLCYPITQPTIQLFHEVLKLVE

SEQ ID NO: 15739 - protein, 126 aa, Homo sapiens
  Payload ID: 3132
  Gene Symbol: C12orf57
  Gene Name: chromosome 12 open reading frame 57
  Uniprot ID: Q99622
  ENSP ID: ENSP00000229281
MASASTQPAALSAEQAKVVLAEVIQAFSAPENAVRMDEARDNACNDMGKMLQFVLPVATQIQQEVIKAYGFSCDGEGVLKFARLVKSYEAQDPEIASLSGKLKALFLPPMTLPPHGPAAGGSVAAS

SEQ ID NO: 15740 - protein, 126 aa, Homo sapiens; identical to SEQ ID NO: 15739
  Payload ID: 3132
  Gene Symbol: C12orf57
  Gene Name: chromosome 12 open reading frame 57
  Uniprot ID: Q99622
  ENSP ID: ENSP00000440602

SEQ ID NO: 15741 - protein, 97 aa, Homo sapiens
  Payload ID: 3132
  Gene Symbol: C12orf57
  Gene Name: chromosome 12 open reading frame 57
  ENSP ID: ENSP00000440937
MASASTQPAALSAEQAKVVLAEVIQAFSAPENAVRMDEARDNACNDMGVLKFARLVKSYEAQDPEIASLSGKLKALFLPPMTLPPHGPAAGGSVAAS

SEQ ID NO: 15742 - protein, 103 aa, Homo sapiens
  Payload ID: 3132
  Gene Symbol: C12orf57
  Gene Name: chromosome 12 open reading frame 57
  ENSP ID: ENSP00000475422
MASASTQPAALSAEQAKVVLAEVIQAFSAPENAVRMDEARDNACNDMGKMLQFVLPVATQIQQEVIKAYGFSCDGEGGSDAGRRVRRGKAGVGSGEGAGSVGP

SEQ ID NO: 15743 - protein, 91 aa, Homo sapiens
  Payload ID: 3132
  Gene Symbol: C12orf57
  Gene Name: chromosome 12 open reading frame 57
  ENSP ID: ENSP00000475635
MDEARDNACNDMGKMLQFVLPVATQIQQEVIKAYGFSCDGEGVLKFARLVKSYEAQDPEIASLSGKLKALFLPPMTLPPHGPAAGGSVAAS

SEQ ID NO: 15744 - protein, 245 aa, Homo sapiens
  Payload ID: 3133
  Gene Symbol: C12orf60
  Gene Name: chromosome 12 open reading frame 60
  Uniprot ID: Q5U649
  ENSP ID: ENSP00000331691
MSSESEKDKERLIQAAKMFFFHVQDLASVINTLTELFSRSMNTQILLMAVKNNSYIKDFFEQMLKIFKEMQSVVDARHDKIQKESLCSKVAMAMCSVVQKSTNVEELHQSAKEVFKSAHTPVIISVLNSSNILGSLESSLSHLMKFPIMNLQLSDFYTEDTKEQSDVTTSERTRSPPGSSKTTMIDTLKKLQDVLKTEDSKNPTKSAADLLEQIVKAMGPILEILQKAIKTMEMNISVFKKASDK

SEQ ID NO: 15745 - protein, 166 aa, Homo sapiens
  Payload ID: 3134
  Gene Symbol: C12orf65
  Gene Name: chromosome 12 open reading frame 65
  Uniprot ID: Q9H3J6
  ENSP ID: ENSP00000253233
MSTVGLFHFPTPLTRICPAPWGLRLWEKLTLLSPGIAVTPVQMAGKKDYPALLSLDENELEEQFVKGHGPGGQATNKTSNCVVLKHIPSGIVVKCHQTRSVDQNRKLARKILQEKVDVFYNGENSPVHKEKREAAKKKQERKKRAKETLEKKKLLKELWESSKKVH

SEQ ID NO: 15746 - protein, 166 aa, Homo sapiens; identical to SEQ ID NO: 15745
  Payload ID: 3134
  Gene Symbol: C12orf65
  Gene Name: chromosome 12 open reading frame 65
  Uniprot ID: Q9H3J6
  ENSP ID: ENSP00000390647

SEQ ID NO: 15747 - protein, 166 aa, Homo sapiens; identical to SEQ ID NO: 15745
  Payload ID: 3134
  Gene Symbol: C12orf65
  Gene Name: chromosome 12 open reading frame 65
  Uniprot ID: Q9H3J6
  ENSP ID: ENSP00000391513

SEQ ID NO: 15748 - protein, 96 aa, Homo sapiens
  Payload ID: 3134
  Gene Symbol: C12orf65
  Gene Name: chromosome 12 open reading frame 65
  ENSP ID: ENSP00000441796
MSTVGLFHFPTPLTRICPAPWGLRLWEKLTLLSPGIAVTPVQMAGKKDYPALLSLDENELEEQFVKGHGPGGQATNKTSNCVVLKHIPSGIVVKVD

SEQ ID NO: 15749 - protein, 36 aa, Homo sapiens
  Payload ID: 3134
  Gene Symbol: C12orf65
  Gene Name: chromosome 12 open reading frame 65
  ENSP ID: ENSP00000443072
MSTVGLFHFPTPLTRICPAPWGLRLWEKLTLLSPGI

SEQ ID NO: 15750 - protein, 138 aa, Homo sapiens
  Payload ID: 3134
  Gene Symbol: C12orf65
  Gene Name: chromosome 12 open reading frame 65
  ENSP ID: ENSP00000444843
MSTVGLFHFPTPLTRICPAPWGLRLWEKLTLLSPGIAVTPVQMAGKKDYPALLSLDENELEEQFVKGHGPGGQATNKTSNCVVLKHIPSGIVVKCHQTRSVDQNRKLARKILQEKVDVFYNGENSPVHKEKREAAKKK

SEQ ID NO: 15751 - protein, 468 aa, Homo sapiens
  Payload ID: 3135
  Gene Symbol: C12orf66
  Gene Name: chromosome 12 open reading frame 66
  ENSP ID: ENSP00000311486
MGESIPLAAPVPVEQAVLETFFSHLGIFSYDKAKDNVEKEREANKSAGGSWLSLLAALAHLAAAEKVYHSLTYLGQKLGGQSFFSRKDSIRTIYTSLHNELKKVVTGRGALGGTAPHVEELLSHLSEQLCFFVQARMEIADFYEKMYTLSTQKFINAEELVGLLDAIMKKYSSRFHHPILSPLESSFQLEVDVLCHLLKAQAQVSEWKFLPSLVNLHSAHTKLQTWGQIFEKQRETKKHLFGGQSQKAVQPPHLFLWLMKLKNMLLAKFSFYFHEALSRQTTASEMKTLTAKANPDFFGKISSFIRKYDAANVSLIFDNRGSESFQGHGYHHPHSYREAPKGVDQYPAVVSLPSDRPVMHWPNVIMIMTDRTSDLNSLEKVVHFYDDKVQSTYFLTRPEPHFTIVIIFESKKSERDSHFISFLNEVSLALKNPKVFASLKPGAKGSCYQCNYFVAFCLNYSKLLLQRK

SEQ ID NO: 15752 - protein, 445 aa, Homo sapiens
  Payload ID: 3135
  Gene Symbol: C12orf66
  Gene Name: chromosome 12 open reading frame 66
  Uniprot ID: Q96MD2
  ENSP ID: ENSP00000381132
MGESIPLAAPVPVEQAVLETFFSHLGIFSYDKAKDNVEKEREANKSAGGSWLSLLAALAHLAAAEKVYHSLTYLGQKLGGQSFFSRKDSIRTIYTSLHNELKKVVTGRGALGGTAPHVEELLSHLSEQLCFFVQARMEIADFYEKMYTLSTQKFINAEELVGLLDAIMKKYSSRFHHPILSPLESSFQLEVDVLCHLLKAQAQVSEWKFLPSLVNLHSAHTKLQTWGQIFEKQRETKKHLFGGQSQKAVQPPHLFLWLMKLKNMLLAKFSFYFHEALSRQTTASEMKTLTAKANPDFFGKISSFIRKYDAANVSLIFDNRGSESFQGHGYHHPHSYREAPKGVDQYPAVVSLPSDRPVMHWPNVIMIMTDRTSDLNSLEKVVHFYDDKVQSTYFLTRPEPHFTIVIIFESKKSERDSHFISFLNEVSLALKNPKVFASLKPGAKG

SEQ ID NO: 15753 - protein, 392 aa, Homo sapiens
  Payload ID: 3135
  Gene Symbol: C12orf66
  Gene Name: chromosome 12 open reading frame 66
  ENSP ID: ENSP00000445481
MGESIPLAAPVPVEQAVLETFFSHLGGQSFFSRKDSIRTIYTSLHNELKKVVTGRGALGGTAPHVEELLSHLSEQLCFFVQARMEIADFYEKMYTLSTQKFINAEELVGLLDAIMKKYSSRFHHPILSPLESSFQLEVDVLCHLLKAQAQVSEWKFLPSLVNLHSAHTKLQTWGQIFEKQRETKKHLFGGQSQKAVQPPHLFLWLMKLKNMLLAKFSFYFHEALSRQTTASEMKTLTAKANPDFFGKISSFIRKYDAANVSLIFDNRGSESFQGHGYHHPHSYREAPKGVDQYPAVVSLPSDRPVMHWPNVIMIMTDRTSDLNSLEKVVHFYDDKVQSTYFLTRPEPHFTIVIIFESKKSERDSHFISFLNEVSLALKNPKVFASLKPGAKG

SEQ ID NO: 15754 - protein, 269 aa, Homo sapiens
  Payload ID: 3136
  Gene Symbol: C12orf71
  Gene Name: chromosome 12 open reading frame 71
  Uniprot ID: A8MTZ7
  ENSP ID: ENSP00000413728
MAYSSSNSDIEDDSSKSNSNLSLSVGYFPCEDTPCEDTTSWEDAPSKGPSIHFLPPVQGAWGTERIGRRMKRQDQIQDEPEQFCKLSIFLAWDVDIGSDNTDSRANRLLNGDNLWIDKLPKERTKLSVGKLNNLVQEFQIFLENLKDDDAVFPETAQQDFQLSSGSPPEMVQMISQATASQRTSAPEISSILSEQPEKDDTPSHTQAQCCLNFGWAFSWLRQRILPSLLRRDHPVNATKSPHRSAPTKRLFHRGKRIQPQETLELGHPI

SEQ ID NO: 15755 - protein, 71 aa, Homo sapiens
  Payload ID: 3137
  Gene Symbol: C12orf73
  Gene Name: chromosome 12 open reading frame 73
  Uniprot ID: Q69YU5
  ENSP ID: ENSP00000367330
MPAGVPMSTYLKMFAASLLAMCAGAEVVHRYYRPDLTIPEIPPKRGELKTELLGLKERKHKPQVSQQEELK

SEQ ID NO: 15756 - protein, 71 aa, Homo sapiens; identical to SEQ ID NO: 15755
  Payload ID: 3137
  Gene Symbol: C12orf73
  Gene Name: chromosome 12 open reading frame 73
  Uniprot ID: Q69YU5
  ENSP ID: ENSP00000446981

SEQ ID NO: 15757 - protein, 53 aa, Homo sapiens
  Payload ID: 3137
  Gene Symbol: C12orf73
  Gene Name: chromosome 12 open reading frame 73
  ENSP ID: ENSP00000447403
MPAGVPMSTYLKMFAASLLAMCAGAEVVHRYYRPDLMRNRLRRVKLISQSHIA

SEQ ID NO: 15758 - protein, 59 aa, Homo sapiens
  Payload ID: 3137
  Gene Symbol: C12orf73
  Gene Name: chromosome 12 open reading frame 73
  ENSP ID: ENSP00000447452
MPAGVPMSTYLKMFAASLLAMCAGAEVVHRYYRPDLQNWITSLSVGELEGLGRVEQRRP

SEQ ID NO: 15759 - protein, 46 aa, Homo sapiens
  Payload ID: 3137
  Gene Symbol: C12orf73
  Gene Name: chromosome 12 open reading frame 73
  ENSP ID: ENSP00000447827
MPAGVPMSTYLKMFAASLLAMCAGAEVVHRYYRPDLVSAGGLLFYF

SEQ ID NO: 15760 - protein, 71 aa, Homo sapiens; identical to SEQ ID NO: 15755
  Payload ID: 3137
  Gene Symbol: C12orf73
  Gene Name: chromosome 12 open reading frame 73
  Uniprot ID: Q69YU5
  ENSP ID: ENSP00000448771

SEQ ID NO: 15761 - protein, 59 aa, Homo sapiens; identical to SEQ ID NO: 15758
  Payload ID: 3137
  Gene Symbol: C12orf73
  Gene Name: chromosome 12 open reading frame 73
  ENSP ID: ENSP00000448863

SEQ ID NO: 15762 - protein, 71 aa, Homo sapiens; identical to SEQ ID NO: 15755
  Payload ID: 3137
  Gene Symbol: C12orf73
  Gene Name: chromosome 12 open reading frame 73
  Uniprot ID: Q69YU5
  ENSP ID: ENSP00000449839

SEQ ID NO: 15763 - protein, 53 aa, Homo sapiens; identical to SEQ ID NO: 15757
  Payload ID: 3137
  Gene Symbol: C12orf73
  Gene Name: chromosome 12 open reading frame 73
  ENSP ID: ENSP00000449951

SEQ ID NO: 15764 - protein, 37 aa, Homo sapiens
  Payload ID: 3137
  Gene Symbol: C12orf73
  Gene Name: chromosome 12 open reading frame 73
  ENSP ID: ENSP00000450253
MPAGVPMSTYLKMFAASLLAMCAGAEVVHRYYRPDLV

SEQ ID NO: 15765 - protein, 190 aa, Homo sapiens
  Payload ID: 3138
  Gene Symbol: C12orf74
  Gene Name: chromosome 12 open reading frame 74
  Uniprot ID: Q32Q52
  ENSP ID: ENSP00000380933
MEKTESFCPEVPPQDCGASPRPSLRSLPKNQGSLLQFDRQAPGRISTSPTLRRLRTRGCGTRQDAWQVTTWGSWGAPVGFPCYLSKSLPGSPKDSSHLLSPLRLHSRLTSEPERALNAADSLEPQTRPTDKYLPPELQPVNEGSLHQASLRQQEGHFLPSPTLRHPSPQGEELHPSRCVCIYFLRCYDIC

SEQ ID NO: 15766 - protein, 173 aa, Homo sapiens
  Payload ID: 3138
  Gene Symbol: C12orf74
  Gene Name: chromosome 12 open reading frame 74
  Uniprot ID: Q32Q52
  ENSP ID: ENSP00000446043
MEKTESFCPEVPPQDCGASPRPSLRSLPKNQGSLLQFDRQAPGRISTSPTLRRLRTRGCGTRQDAWQVTTWGSWGAPVGFPCYLSKSLPGSPKDSSHLLSPLRLHSRLTSEPERALNAADSLEPQTRPTDKYLPPELQPVNEGSLHQASLRQQEGHFLPSPTLRHPSPQVTQL

SEQ ID NO: 15767 - protein, 46 aa, Homo sapiens
  Payload ID: 3139
  Gene Symbol: C12orf75
  Gene Name: chromosome 12 open reading frame 75
  ENSP ID: ENSP00000447440
MGCGNSTATSAGAGQETMEEYMLAYHLKLSIWCPVKQRRFGKIRRK

SEQ ID NO: 15768 - protein, 63 aa, Homo sapiens
  Payload ID: 3139
  Gene Symbol: C12orf75
  Gene Name: chromosome 12 open reading frame 75
  Uniprot ID: Q8TAD7
  ENSP ID: ENSP00000448536
MGCGNSTATSAGAGQGPAGAAKDVTEESVTEDDKRRNYGGVYVGLPSEAVNMVSSQTKTVRKN

SEQ ID NO: 15769 - protein, 48 aa, Homo sapiens
  Payload ID: 3139
  Gene Symbol: C12orf75
  Gene Name: chromosome 12 open reading frame 75
  ENSP ID: ENSP00000449096
MGCGNSTATSAGAGQGPAGAAKDVPFSSTTWVRLCHCLMDQLYSNSRR

SEQ ID NO: 15770 - protein, 89 aa, Homo sapiens
  Payload ID: 3139
  Gene Symbol: C12orf75
  Gene Name: chromosome 12 open reading frame 75
  ENSP ID: ENSP00000450095
MGCGNSTATSAGAGQGPAGAAKDVTEESVTEDDKRRNYGGVYVGLPSEAVNMVSSQTKTVRKKENNIMTQESRACSSVWKEFGSVGRCN

SEQ ID NO: 15771 - protein, 51 aa, Homo sapiens
  Payload ID: 3139
  Gene Symbol: C12orf75
  Gene Name: chromosome 12 open reading frame 75
  ENSP ID: ENSP00000479631
MGCGNSTATSAGAGQGPAGAAKDVNYGGVYVGLPSEAVNMVSSQTKTVRKN

SEQ ID NO: 15772 - protein, 135 aa, Homo sapiens
  Payload ID: 3140
  Gene Symbol: C12orf76
  Gene Name: chromosome 12 open reading frame 76
  Uniprot ID: Q8N812
  ENSP ID: ENSP00000308368
MFQNLQGTFEKEIGKIIPFTIAFKRAEAVEPDGCVQSWRCCLPCDLGQASRFIHTTVCSAIRWRSCKGERNFAERHILPAELEEQSNHAGMGPILPAMPSVDGNHFQHPAGDCHPYGILCLQAHSASVTARQVLQ

SEQ ID NO: 15773 - protein, 76 aa, Homo sapiens
  Payload ID: 3140
  Gene Symbol: C12orf76
  Gene Name: chromosome 12 open reading frame 76
  ENSP ID: ENSP00000446788
MLRPALPWLYLGLCSLLVGEAEAPSPVDPLERSRPYAVLRGQNLESLSPRLECNGAISARCNLRVWGSSDSPASAP

SEQ ID NO: 15774 - protein, 49 aa, Homo sapiens
  Payload ID: 3140
  Gene Symbol: C12orf76
  Gene Name: chromosome 12 open reading frame 76
  ENSP ID: ENSP00000447351
MLRPALPWLYLGLCSLLVGEAEAPSPVDPLERSRPYAVLRGQNLDQTLH

SEQ ID NO: 15775 - protein, 61 aa, Homo sapiens
  Payload ID: 3140
  Gene Symbol: C12orf76
  Gene Name: chromosome 12 open reading frame 76
  ENSP ID: ENSP00000447574
MLRPALPWLYLGLCSLLVGEAEAPSPVDPLERSRPYAVLRGQNLETTGERICLQLFAQHLT

SEQ ID NO: 15776 - protein, 76 aa, Homo sapiens; identical to SEQ ID NO: 15773
  Payload ID: 3140
  Gene Symbol: C12orf76
  Gene Name: chromosome 12 open reading frame 76
  ENSP ID: ENSP00000448915

SEQ ID NO: 15777 - protein, 107 aa, Homo sapiens
  Payload ID: 3140
  Gene Symbol: C12orf76
  Gene Name: chromosome 12 open reading frame 76
  ENSP ID: ENSP00000449939
MLERENESHGSKSCSRARIGTEVACRACLPPHCAMPPIDAFLCLPFSFALVSGKLYQWKEPVISSVHSKVKRTAEVKEEIVEKEMKKLVHSVFNMADYTFPLQVNTW

SEQ ID NO: 15778 - protein, 72 aa, Homo sapiens
  Payload ID: 3140
  Gene Symbol: C12orf76
  Gene Name: chromosome 12 open reading frame 76
  ENSP ID: ENSP00000450232
MLRPALPWLYLGLCSLLVGEAEAPSPVDPLERSRPYAVLRGQNLVLMGTIFSILLVTVILMAFCVYKPIRRR

SEQ ID NO: 15779 - protein, 135 aa, Homo sapiens [sequence omitted]

SEQ ID NO: 15780 - protein, 140 aa, Homo sapiens
  Payload ID: 3141
  Gene Symbol: C14orf1
  Gene Name: chromosome 14 open reading frame 1
  Uniprot ID: Q9UKR5
  ENSP ID: ENSP00000256319
MSRFLNVLRSWLVMVSIIAMGNTLQSFRDHTFLYEKLYTGKPNLVNGLQARTFGIWTLLSSVIRCLCAIDIHNKTLYHITLWTFLLALGHFLSELFVYGTAAPTIGVLAPLMVASFSILGMLVGLRYLEVEPVSRQKKRN

SEQ ID NO: 15781 - protein, 296 aa, Homo sapiens
  Payload ID: 3142
  Gene Symbol: C14orf105
  Gene Name: chromosome 14 open reading frame 105
  Uniprot ID: Q9NVL8
  ENSP ID: ENSP00000216445
MGLSHSKTHLRVIKVAPLQNKEVETPSAGRVDFAFNQNLEEKTSYSLARLQDQNKALEGQLPPLQENWYGRYSTASRDMYFDIPLEHRETSIIKRHPPQRLQKLEPIDLPRVITSGRLLSQREARTMHKAKQVLEKKMQTPMYTSENRQYLHKMQVLEMIRKRQEAQMELKKSLHGEARINKQSPRDHKAKKTLQSTPRNDDHDLLTMLPDEILNRGPGNSKNTEFLKHQAVNNYCPWKIGKMETWLHEQEAQGQLLWDSSSSDSDEQGKDEKKPRALVRTRTERIPLFDEFFDQE

SEQ ID NO: 15782 - protein, 336 aa, Homo sapiens
  Payload ID: 3142
  Gene Symbol: C14orf105
  Gene Name: chromosome 14 open reading frame 105
  ENSP ID: ENSP00000392368
MGLSHSKTHLRVIKVAPLQNKEVETPSAGRVDFAFNQNLEEKTSYSLARLQDQNKALEGQLPPLQENWYGRYSTASRDMYFDIPLEHRETSIIKRHPPQRLQKLEPIDLPRVITSGRLLSQREARTMHKAKVLEKKMQTPMYTSENRQYLHKMQVLEMIRKRQEAQMELKKSLHGEARINKQSPRDHKAKKTLQSTPRNDDHDLLTMLPDEILNRGPDRVSLLLPRLECNGMISAHRKLRLPSSNDSPASASRVAGITGNSKNTEFLKHQAVNNYCPWKIGKMETWLHEQEAQGQLLWDSSSSDSDEQGKDEKKPRALVRTRTERIPLFDEFFDQE

SEQ ID NO: 15783 - protein, 104 aa, Homo sapiens
  Payload ID: 3142
  Gene Symbol: C14orf105
  Gene Name: chromosome 14 open reading frame 105
  ENSP ID: ENSP00000431623
MGLSHSKTHLRVIKVAPLQNKEVETPSAGRVDFAFNQNLEEKTSYSLARLQDQNKALEGQLPPLQENWYGRYSTASRDMYFDIPLEHRETSIIKRHPPQRLQVR

SEQ ID NO: 15784 - protein, 74 aa, Homo sapiens
  Payload ID: 3142
  Gene Symbol: C14orf105
  Gene Name: chromosome 14 open reading frame 105
  ENSP ID: ENSP00000431919
MGLSHSKTHLRVIKVAPLQNKEVETPSAGRVDFAFNQNLEEKTSYSLARLQDQNKALEGQLPPLQENCIQRHVF

SEQ ID NO: 15785 - protein, 295 aa, Homo sapiens
  Payload ID: 3142
  Gene Symbol: C14orf105
  Gene Name: chromosome 14 open reading frame 105
  ENSP ID: ENSP00000434003
MGLSHSKTHLRVIKVAPLQNKEVETPSAGRVDFAFNQNLEEKTSYSLARLQDQNKALEGQLPPLQENWYGRYSTASRDMYFDIPLEHRETSIIKRHPPQRLQKLEPIDLPRVITSGRLLSQREARTMHKAKVLEKKMQTPMYTSENRQYLHKMQVLEMIRKRQEAQMELKKSLHGEARINKQSPRDHKAKKTLQSTPRNDDHDLLTMLPDEILNRGPGNSKNTEFLKHQAVNNYCPWKIGKMETWLHEQEAQGQLLWDSSSSDSDEQGKDEKKPRALVRTRTERIPLFDEFFDQE

SEQ ID NO: 15786 - protein, 136 aa, Homo sapiens
  Payload ID: 3142
  Gene Symbol: C14orf105
  Gene Name: chromosome 14 open reading frame 105
  ENSP ID: ENSP00000436475
  MOD_RES (1)..(1): Any amino acid
XVLEMIRKRQEAQMELKKSLHGEARINKQSPRDHKAKKTLQSTPRNDDHDLLTMLPDEILNRGPDRVSLLLPRLECNGMISAHRKLRLPSSNDSPASASRVAGITGACHHAQLTFVFVVETRFHHVGQAGLELLTS

SEQ ID NO: 15787 - protein, 104 aa, Homo sapiens; identical to SEQ ID NO: 15783
  Payload ID: 3142
  Gene Symbol: C14orf105
  Gene Name: chromosome 14 open reading frame 105
  ENSP ID: ENSP00000436517

SEQ ID NO: 15788 - protein, 74 aa, Homo sapiens; identical to SEQ ID NO: 15784
  Payload ID: 3142
  Gene Symbol: C14orf105
  Gene Name: chromosome 14 open reading frame 105
  ENSP ID: ENSP00000436589

SEQ ID NO: 15789 - protein, 104 aa, Homo sapiens; identical to SEQ ID NO: 15783
  Payload ID: 3142
  Gene Symbol: C14orf105
  Gene Name: chromosome 14 open reading frame 105
  ENSP ID: ENSP00000436784

SEQ ID NO: 15790 - protein, 140 aa, Homo sapiens
  Payload ID: 3143
  Gene Symbol: C14orf119
  Gene Name: chromosome 14 open reading frame 119
  Uniprot ID: Q9NWQ9
  ENSP ID: ENSP00000322238
MPLESSSSMPLSFPSLLPSVPHNTNPSPPLMSYITSQEMKCILHWFANWSGPQRERFLEDLVAKAVPEKLQPLLDSLEQLSVSGADRPPSIFECQLHLWDQWFRGWAEQERNEFVRQLEFSEPDFVAKFYQAVAATAGKD

SEQ ID NO: 15791 - protein, 140 aa, Homo sapiens; identical to SEQ ID NO: 15790
  Payload ID: 3143
  Gene Symbol: C14orf119
  Gene Name: chromosome 14 open reading frame 119
  Uniprot ID: Q9NWQ9
  ENSP ID: ENSP00000450861

SEQ ID NO: 15792 - protein, 100 aa, Homo sapiens
  Payload ID: 3144
  Gene Symbol: C14orf142
  Gene Name: chromosome 14 open reading frame 142
  Uniprot ID: Q9BXV9
  ENSP ID: ENSP00000306320
MELLGEYVGQEGKPQKLRVSCEAPGDGDPFQGLLSGVAQMKDMVTELFDPLVQGEVQHRVAAAPDEDLDGDDEDDAEDENNIDNRTNFDGPSAKRPKTPS

SEQ ID NO: 15793 - protein, 79 aa, Homo sapiens
  Payload ID: 3144
  Gene Symbol: C14orf142
  Gene Name: chromosome 14 open reading frame 142
  ENSP ID: ENSP00000451114
  MOD_RES (1)..(1): Any amino acid
XLGEYVGQEGKPQKLRVSCEAPGDGDPFQGLLSGVAQMKDMVMMKMMQKMKITLITELTSMDHLQNGQKHRLNNSLHDI

SEQ ID NO: 15794 - protein, 100 aa, Homo sapiens; identical to SEQ ID NO: 15792
  Payload ID: 3144
  Gene Symbol: C14orf142
  Gene Name: chromosome 14 open reading frame 142
  Uniprot ID: Q9BXV9
  ENSP ID: ENSP00000478863

SEQ ID NO: 15795 - protein, 79 aa, Homo sapiens; identical to SEQ ID NO: 15793
  Payload ID: 3144
  Gene Symbol: C14orf142
  Gene Name: chromosome 14 open reading frame 142
  ENSP ID: ENSP00000487326
  MOD_RES (1)..(1): Any amino acid

SEQ ID NO: 15796 - protein, 621 aa, Homo sapiens
  Payload ID: 3145
  Gene Symbol: C14orf159
  Gene Name: chromosome 14 open reading frame 159
  Uniprot ID: Q7Z3D6
  ENSP ID: ENSP00000256324
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYKTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 15797 - protein, 159 aa, Homo sapiens
  Payload ID: 3145
  Gene Symbol: C14orf159
  Gene Name: chromosome 14 open reading frame 159
  Uniprot ID: Q7Z3D6
  ENSP ID: ENSP00000298858
MPFTLHLRSRLPSAIRSLILQKKPNIRNTSSMAGELRPASLVVLPRSLAPAFERFCQVNTGPLPLLGQSEPEKWMLPPQGAISETSLRDLHSAWHRTSLMTVAQERAALPTVLTPSPITWRLSWLRSLRSWRKSSPGEIPLALPSVHSIAQARNPPVQD

SEQ ID NO: 15798 - protein, 621 aa, Homo sapiens; identical to SEQ ID NO: 15796
  Payload ID: 3145
  Gene Symbol: C14orf159
  Gene Name: chromosome 14 open reading frame 159
  Uniprot ID: Q7Z3D6
  ENSP ID: ENSP00000404196

SEQ ID NO: 15799 - protein, 616 aa, Homo sapiens
  Payload ID: 3145
  Gene Symbol: C14orf159
  Gene Name: chromosome 14 open reading frame 159
  Uniprot ID: Q7Z3D6
  ENSP ID: ENSP00000404343
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 15800 - protein, 616 aa, Homo sapiens; identical to SEQ ID NO: 15799
  Payload ID: 3145
  Gene Symbol: C14orf159
  Gene Name: chromosome 14 open reading frame 159
  Uniprot ID: Q7Z3D6
  ENSP ID: ENSP00000427953

SEQ ID NO: 15801 - protein, 85 aa, Homo sapiens
  Payload ID: 3145
  Gene Symbol: C14orf159
  Gene Name: chromosome 14 open reading frame 159
  ENSP ID: ENSP00000427971
MPFTLHLRSRLPSAIRSLILQKKPNIRNTSSMAGELRPASLVVLPRSLAPAFERFCQVNTGPLPLLGQSEPEKWMLPPQGAISET

SEQ ID NO: 15802 - protein, 83 aa, Homo sapiens
  Payload ID: 3145
  Gene Symbol: C14orf159
  Gene Name: chromosome 14 open reading frame 159
  ENSP ID: ENSP00000428122
MPFTLHLRSRLPSAIRSLILQKKPNIRNTSSMAGELRPASLVVLPRSLAPAFERFCQVNTGPLPLLGQSEPEKWMLPPQGAIS

SEQ ID NO: 15803 - protein, 621 aa, Homo sapiens; identical to SEQ ID NO: 15796
  Payload ID: 3145
  Gene Symbol: C14orf159
  Gene Name: chromosome 14 open reading frame 159
  Uniprot ID: Q7Z3D6
  ENSP ID: ENSP00000428263

SEQ ID NO: 15804 - protein, 201 aa, Homo sapiens
  Payload ID: 3145
  Gene Symbol: C14orf159
  Gene Name: chromosome 14 open reading frame 159
  ENSP ID: ENSP00000428296
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYKTTVPCVTHAGFCCPLVVTMRPIPKDKLEGLVRACCSLGGEQGQPVHMGD

SEQ ID NO: 15805 - protein, 564 aa, Homo sapiens
  Payload ID: 3145
  Gene Symbol: C14orf159
  Gene Name: chromosome 14 open reading frame 159
  ENSP ID: ENSP00000428444
  MOD_RES (1)..(1): Any amino acid
XSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYKTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKESKGRKL

SEQ ID NO: 15806 - protein, 276 aa, Homo sapiens
  Payload ID: 3145
  Gene Symbol: C14orf159
  Gene Name: chromosome 14 open reading frame 159
  ENSP ID: ENSP00000428462
  MOD_RES (1)..(1): Any amino acid
XPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKSGWGRCQGVPEPGLMVAAGGLCQGELPQPEQKEVKAKTELGPPDAMWRHVGLSVFPRVAGRQMEPFLPLPHSPARSRQPALPCLLQDETMIIPAPSCSTGSLSTMFPP

SEQ ID NO: 15807 - protein, 431 aa, Homo sapiens
  Payload ID: 3145
  Gene Symbol: C14orf159
  Gene Name: chromosome 14 open reading frame 159
  ENSP ID: ENSP00000428652
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYKTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTP

SEQ ID NO: 15808 - protein, 506 aa, Homo sapiens
  Payload ID: 3145
  Gene Symbol: C14orf159
  Gene Name: chromosome 14 open reading frame 159
  ENSP ID: ENSP00000428760
  MOD_RES (1)..(1): Any amino acid
XCTGSLASLEQYSEQLKDMVAFFLGCSFSLEEALEKAGLPRRDPAGHSQAGAYKTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGEHSDGRPVRPATQGVSNWGGYALACALYILYSCAVHSQYLRKAVGPSRAPGDQAWTQALPSVIKVTNPSQPLAWKQLLPWMSSRPEVPSRKPRAGTLLPLKSQRQSQP

SEQ ID NO: 15809 - protein, 616 aa, Homo sapiens; identical to SEQ ID NO: 15799
  Payload ID: 3145
  Gene Symbol: C14orf159
  Gene Name: chromosome 14 open reading frame 159
  Uniprot ID: Q7Z3D6
  ENSP ID: ENSP00000428974

SEQ ID NO: 15810 - protein, 25 aa, Homo sapiens
  Payload ID: 3145
  Gene Symbol: C14orf159
  Gene Name: chromosome 14 open reading frame 159
  ENSP ID: ENSP00000428997
MPFTLHLRSRLPSAIRSLILQKKPN

SEQ ID NO: 15811 - protein, 37 aa, Homo sapiens
  Payload ID: 3145
  Gene Symbol: C14orf159
  Gene Name: chromosome 14 open reading frame 159
  ENSP ID: ENSP00000429052
MPFTLHLRSRLPSAIRSLILQKKPNIRNTSSMAGGFH

SEQ ID NO: 15812 - protein, 52 aa, Homo sapiens
  Payload ID: 3145
  Gene Symbol: C14orf159
  Gene Name: chromosome 14 open reading frame 159
  ENSP ID: ENSP00000429097
MPFTLHLRSRLPSAIRSLILQKKPNIRNTSSMAGELRPASLVVLPRSLAPAF

SEQ ID NO: 15813 - protein, 159 aa, Homo sapiens; identical to SEQ ID NO: 15797
  Payload ID: 3145
  Gene Symbol: C14orf159
  Gene Name: chromosome 14 open reading frame 159
  Uniprot ID: Q7Z3D6
  ENSP ID: ENSP00000429098

SEQ ID NO: 15814 - protein, 109 aa, Homo sapiens
  Payload ID: 3145
  Gene Symbol: C14orf159
  Gene Name: chromosome 14 open reading frame 159
  ENSP ID: ENSP00000429189
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQ

SEQ ID NO: 15815 - protein, 125 aa, Homo sapiens
  Payload ID: 3145
  Gene Symbol: C14orf159
  Gene Name: chromosome 14 open reading frame 159
  ENSP ID: ENSP00000429392
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCS

SEQ ID NO: 15816 - protein, 564 aa, Homo sapiens
  Payload ID: 3145
  Gene Symbol: C14orf159
  Gene Name: chromosome 14 open reading frame 159
  Uniprot ID: Q7Z3D6
  ENSP ID: ENSP00000429453
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQTTVPCVTHAGFCCPLVVTMRPIPKDKLEGLVRACCSLGELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 15817 - protein, 152 aa, Homo sapiens
  Payload ID: 3145
  Gene Symbol: C14orf159
  Gene Name: chromosome 14 open reading frame 159
  ENSP ID: ENSP00000429459
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYK

SEQ ID NO: 15818 - protein, 616 aa, Homo sapiens; identical to SEQ ID NO: 15799
  Payload ID: 3145
  Gene Symbol: C14orf159
  Gene Name: chromosome 14 open reading frame 159
  Uniprot ID: Q7Z3D6
  ENSP ID: ENSP00000429655

SEQ ID NO: 15819 - protein, 64 aa, Homo sapiens
  Payload ID: 3145
  Gene Symbol: C14orf159
  Gene Name: chromosome 14 open reading frame 159
  ENSP ID: ENSP00000429806
MPFTLHLRSRLPSAIRSLILQKKPNIRNTSSMAGELRPASLVVLPRSLAPAFERFCQVNTGPLP

SEQ ID NO: 15820 - protein, 86 aa, Homo sapiens
  Payload ID: 3145
  Gene Symbol: C14orf159
  Gene Name: chromosome 14 open reading frame 159
  ENSP ID: ENSP00000429949
MPFTLHLRSRLPSAIRSLILQKKPNIRNTSSMAGELRPASLVVLPRSLAPAFERFCQVNTGPLPLLGQSEPEKWMLPPQGAISETR

SEQ ID NO: 15821 - protein, 104 aa, Homo sapiens
  Payload ID: 3145
  Gene Symbol: C14orf159
  Gene Name: chromosome 14 open reading frame 159
  ENSP ID: ENSP00000429967
MPFTLHLRSRLPSAIRSLILQKKPNIRNTSSMAGELRPASLVVLPRSLAPAFERFCQVNTGPLPLLGQSEPEKWMLPPQGAISETRQQCLVLPMLASAALWWSR

SEQ ID NO: 15822 - protein, 152 aa, Homo sapiens; identical to SEQ ID NO: 15817
  Payload ID: 3145
  Gene Symbol: C14orf159
  Gene Name: chromosome 14 open reading frame 159
  ENSP ID: ENSP00000430022

SEQ ID NO: 15823 - protein, 581 aa, Homo sapiens
  Payload ID: 3145
  Gene Symbol: C14orf159
  Gene Name: chromosome 14 open reading frame 159
  Uniprot ID: Q7Z3D6
  ENSP ID: ENSP00000430137
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYKTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 15824 - protein, 94 aa, Homo sapiens
  Payload ID: 3145
  Gene Symbol: C14orf159
  Gene Name: chromosome 14 open reading frame 159
  ENSP ID: ENSP00000430318
MPFTLHLRSRLPSAIRSLILQKKPNIRNTSSMAGELRPASLVVLPRSLAPAFERFCQVNTGPLPLLGQSEPEKWMLPPQGAISETRNELPSPLF

SEQ ID NO: 15825 - protein, 202 aa, Homo sapiens
  Payload ID: 3145
  Gene Symbol: C14orf159
  Gene Name: chromosome 14 open reading frame 159
  ENSP ID: ENSP00000430666
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYKTTVPCVTHAGFCCPLVVTMRPIPKDKLEGLVRACCSLGGEQGQPVHMGDP

SEQ ID NO: 15826 - protein, 581 aa, Homo sapiens; identical to SEQ ID NO: 15823
  Payload ID: 3145
  Gene Symbol: C14orf159
  Gene Name: chromosome 14 open reading frame 159
  Uniprot ID: Q7Z3D6
  ENSP ID: ENSP00000435459

SEQ ID NO: 15827 - protein, 244 aa, Homo sapiens
  Payload ID: 3146
  Gene Symbol: C14orf166
  Gene Name: chromosome 14 open reading frame 166
  Uniprot ID: Q9Y224
  ENSP ID: ENSP00000261700
MFRRKLTALDYHNPAGFNCKDETEFRNFIVWLEDQKIRHYKIEDRGNLRNIHSSDWPKFFEKYLRDVNCPFKIQDRQEAIDWLLGLAVRLEYGDNAEKYKDLVPDNSKTADNATKNAEPLINLDVNNPDFKAGVMALANLLQIQRHDDYLVMLKAIRILVQERLTQDAVAKANQTKEGLPVALDKHILGFDTGDAVLNEAAQILRLLHIEELRELQTKINEAIVAVQAIIADPKTDHRLGKVGR

SEQ ID NO: 15828 - protein, 129 aa, Homo sapiens
  Payload ID: 3146
  Gene Symbol: C14orf166
  Gene Name: chromosome 14 open reading frame 166
  ENSP ID: ENSP00000451153
LRDVNCPFKIQDRQEAIDWLLGLAVRLEYGDNAEKYKDLVPDNSKTADNATKNAEPLINLDVNNPDFKAGVMALANLLQIQRHDDYLVMLKAIRILVQERLTQDAVAKANQTKEMQFLMKLLKFCDCCT

SEQ ID NO: 15829 - protein, 193 aa, Homo sapiens
  Payload ID: 3146
  Gene Symbol: C14orf166
  Gene Name: chromosome 14 open reading frame 166
  ENSP ID: ENSP00000451715
MFRRKLTALDYHNPAGFNCKDETEFRNFIVWLEDQKIRHYKIEDRGNLRNIHSSDWPKFFEKYLRDVNCPFKIQDRQEAIDWLLGLAVRLEYGDNAEKYKDLVPDNSKTADNATKNAEPLINLDVNNPDFKAGVMALANLLQIQRHDDYLVMLKAIRILVQERLTQDAVAKANQTKEEMQFLMKLLKFCDCCT

SEQ ID NO: 15830 - protein, 68 aa, Homo sapiens
  Payload ID: 3146
  Gene Symbol: C14orf166
  Gene Name: chromosome 14 open reading frame 166
  ENSP ID: ENSP00000451751
MFRRKLTALDYHNPAGFNCKDETEFRNFIVWLEDQKIRHYKIEDRGNLRNIHSSDWPKFFEKLKNTRI

SEQ ID NO: 15831 - protein, 641 aa, Homo sapiens
  Payload ID: 3147
  Gene Symbol: C14orf169
  Gene Name: chromosome 14 open reading frame 169
  Uniprot ID: Q9H6W3
  ENSP ID: ENSP00000477507
MDGLQASAGPLRRGRPKRRRKPQPHSGSVLALPLRSRKIRKQLRSVVSRMAALRTQTLPSENSEESRVESTADDLGDALPGGAAVAAVPDAARREPYGHLGPAELLEASPAARSLQTPSARLVPASAPPARLVEVPAAPVRVVETSALLCTAQHLAAVQSSGAPATASGPQVDNTGGEPAWDSPLRRVLAELNRIPSSRRRAARLFEWLIAPMPPDHFYRRLWEREAVLVRRQDHTYYQGLFSTADLDSMLRNEEVQFGQHLDAARYINGRRETLNPPGRALPAAAWSLYQAGCSLRLLCPQAFSTTVWQFLAVLQEQFGSMAGSNVYLTPPNSQGFAPHYDDIEAFVLQLEGRKLWRVYRPRVPTEELALTSSPNFSQDDLGEPVLQTVLEPGDLLYFPRGFIHQAECQDGVHSLHLTLSTYQRNTWGDFLEAILPLAVQAAMEENVEFRRGLPRDFMDYMGAQHSDSKDPRRTAFMEKVRVLVARLGHFAPVDAVADQRAKDFIHDSLPPVLTDRERALSVYGLPIRWEAGEPVNVGAQLTTETEVHMLQDGIARLVGEGGHLFLYYTVENSRVYHLEEPKCLEIYPQQADAMELLLGSYPEFVRVGDLPCDSVEDQLSLATTLYDKGLLLTKMPLALN

SEQ ID NO: 15832 - protein, 125 aa, Homo sapiens
  Payload ID: 3148
  Gene Symbol: C14orf177
  Gene Name: chromosome 14 open reading frame 177
  Uniprot ID: Q52M58
  ENSP ID: ENSP00000321360
MHRKEPGARLEATRGAARPHKQGTKPMITRPSVSQLGEGKCPSSQHLQSLRHNKQHALTLTKARCCGECSTCFCTEEKSECQRHEETSPGSCNHQIMSASTISAFCATPRFKQLFKGTVEQMSQM

SEQ ID NO: 15833 - protein, 75 aa, Homo sapiens
  Payload ID: 3148
  Gene Symbol: C14orf177
  Gene Name: chromosome 14 open reading frame 177
  ENSP ID: ENSP00000440687
MHRKEPGARLEATRGAARPHKQGTKPMITRPSVSQLGEGKCPSSQHLQSLRHNKQHALTLTKARCCGECSTCFCT

SEQ ID NO: 15834 - protein, 122 aa, Homo sapiens
  Payload ID: 3149
  Gene Symbol: C14orf178
  Gene Name: chromosome 14 open reading frame 178
  Uniprot ID: Q8N769
  ENSP ID: ENSP00000348145
MGREMKKTGTPRPFRIEDPNQQPTWHDQPEMGSHYFAQAGLELLGSSNPPASASQSAGITGVSHCARPGEHDLNHTVFQVKDSTFLRHLESDRPEFKSCLPPHFTEPSVSLSTSEGCEDAMG

SEQ ID NO: 15835 - protein, 92 aa, Homo sapiens
  Payload ID: 3149
  Gene Symbol: C14orf178
  Gene Name: chromosome 14 open reading frame 178
  ENSP ID: ENSP00000407405
MGSHYFAQAGLELLGSSNPPASASQSAGITGVSHCARPGEHDLNHTVFQVKDSTFLRHLESDRPEFKSCLPPHFTEPSVSLSTSEGCEDAMG

SEQ ID NO: 15836 - protein, 24 aa, Homo sapiens
  Payload ID: 3149
  Gene Symbol: C14orf178
  Gene Name: chromosome 14 open reading frame 178
  Uniprot ID: Q8N769
  ENSP ID: ENSP00000451236
MGREMKKTGTPRPFRIEDPNQQPT

SEQ ID NO: 15837 - protein, 37 aa, Homo sapiens
  Payload ID: 3149
  Gene Symbol: C14orf178
  Gene Name: chromosome 14 open reading frame 178
  Uniprot ID: Q8N769
  ENSP ID: ENSP00000451531
MGREMKKTGTPRPFRIEDPNQQPTWHDQPGTESVFWL

SEQ ID NO: 15838 - protein, 177 aa, Homo sapiens
  Payload ID: 3150
  Gene Symbol: C14orf180
  Gene Name: chromosome 14 open reading frame 180
  ENSP ID: ENSP00000333041
MRTAAGAVSPDSRPETRRQTRKNEEAAWGPRVCRAEREDNRKCPPSILKRSRPEHHRPEAKPQRTSRRVWFREPPAVTVHYIADKNATATVRAVCVRPARAGPGPILRPGQARGNGTGGPAGPAPRPCPAPAARGPHLLARPPAALTGRTGRTGRASRRAQALRGLRDSLSPGPAAW

SEQ ID NO: 15839 - protein, 160 aa, Homo sapiens
  Payload ID: 3150
  Gene Symbol: C14orf180
  Gene Name: chromosome 14 open reading frame 180
  Uniprot ID: Q8N912
  ENSP ID: ENSP00000386487
MRTAAGAVSPDSRPETRRQTRKNEEAAWGPRVCRAEREDNRKCPPSILKRSRPEHHRPEAKPQRTSRRVWFREPPAVTVHYIADKNATATVRVPGRPRPHGGSLLLQLCVCVLLVLALGLYCGRAKPVATALEDLRARLLGLVLHLRHVALTCWRGLLRL

SEQ ID NO: 15840 - protein, 160 aa, Homo sapiens; identical to SEQ ID NO: 15839
  Payload ID: 3150
  Gene Symbol: C14orf180
  Gene Name: chromosome 14 open reading frame 180
  Uniprot ID: Q8N912
  ENSP ID: ENSP00000452502

SEQ ID NO: 15841 - protein, 160 aa, Homo sapiens; identical to SEQ ID NO: 15839
  Payload ID: 3150
  Gene Symbol: C14orf180
  Gene Name: chromosome 14 open reading frame 180
  Uniprot ID: Q8N912
  ENSP ID: ENSP00000480567

SEQ ID NO: 15842 - protein, 177 aa, Homo sapiens; identical to SEQ ID NO: 15838
  Payload ID: 3150
  Gene Symbol: C14orf180
  Gene Name: chromosome 14 open reading frame 180
  ENSP ID: ENSP00000481876

SEQ ID NO: 15843 - protein, 160 aa, Homo sapiens; identical to SEQ ID NO: 15839
  Payload ID: 3150
  Gene Symbol: C14orf180
  Gene Name: chromosome 14 open reading frame 180
  Uniprot ID: Q8N912
  ENSP ID: ENSP00000487058

SEQ ID NO: 15844 - protein, 58 aa, Homo sapiens
  Payload ID: 3151
  Gene Symbol: C14orf2
  Gene Name: chromosome 14 open reading frame 2
  Uniprot ID: P56378
  ENSP ID: ENSP00000286953
MLQSIIKNIWIPMKPYYTKVYQEIWIGMGLMGFIVYKIRAADKRSKALKASAPAPGHH

SEQ ID NO: 15845 - protein, 75 aa, Homo sapiens
  Payload ID: 3151
  Gene Symbol: C14orf2
  Gene Name: chromosome 14 open reading frame 2
  Uniprot ID: P56378
  ENSP ID: ENSP00000401770
MKLYGTRGSDISHFQCQMLQSIIKNIWIPMKPYYTKVYQEIWIGMGLMGFIVYKIRAADKRSKALKASAPAPGHH

SEQ ID NO: 15846 - protein, 58 aa, Homo sapiens; identical to SEQ ID NO: 15844
  Payload ID: 3151
  Gene Symbol: C14orf2
  Gene Name: chromosome 14 open reading frame 2
  Uniprot ID: P56378
  ENSP ID: ENSP00000450894

SEQ ID NO: 15847 - protein, 99 aa, Homo sapiens
  Payload ID: 3151
  Gene Symbol: C14orf2
  Gene Name: chromosome 14 open reading frame 2
  ENSP ID: ENSP00000451500
MLQSIIKNIWIPMKPYYTKVYQEIWIGMGLMGFIVYKIRAAEMGFCHVTQAGLELLGSSSPPILASQSAGINKREPQHLAQLGNFEQDFNIRIIKEVRL

SEQ ID NO: 15848 - protein, 58 aa, Homo sapiens; identical to SEQ ID NO: 15844
  Payload ID: 3151
  Gene Symbol: C14orf2
  Gene Name: chromosome 14 open reading frame 2
  Uniprot ID: P56378
  ENSP ID: ENSP00000452133

SEQ ID NO: 15849 - protein, 99 aa, Homo sapiens; identical to SEQ ID NO: 15847
  Payload ID: 3151
  Gene Symbol: C14orf2
  Gene Name: chromosome 14 open reading frame 2
  ENSP ID: ENSP00000452186

SEQ ID NO: 15850 - protein, 77 aa, Homo sapiens
  Payload ID: 3151
  Gene Symbol: C14orf2
  Gene Name: chromosome 14 open reading frame 2
  ENSP ID: ENSP00000452462
MLQSIIKNIWIPMKPYYTKVYQEIWIGMGLMGFIVYKIRAADKRSKALKGKIFASENGWEWKTASCLFRTRYIVVLN

SEQ ID NO: 15851 - protein, 310 aa, Homo sapiens
  Payload ID: 3152
  Gene Symbol: C14orf28
  Gene Name: chromosome 14 open reading frame 28
  Uniprot ID: Q4W4Y0
  ENSP ID: ENSP00000326846
MKTLFEEIKASIKNNYNQDRSFCRPVLPWGGVFTIKAGRKAVSCTPLYVEIRLKNTCTIDGFLMLLYVILNENENFPRELSLHFGREFVDCFLYLMDTYSFTTVKLLWIWDKMEKQQYKSEVHKASLIIDLFGNEHDNFTKNLENLMSTIQESYCSNWRCPTRVQEDQQRTININPPQEIPHGNLIRLAVNELFCSKIELCEEHGCGGLREFSQRIFCHGAPPFVVLNMQHWKSEDLAYVPYYLDLSDHKYLLEGATLFNKEEHHYSAAFQIGGHWMHYDGLRNVNLILLNKPPEFLLLSSLVYIRATEK

SEQ ID NO: 15852 - protein, 280 aa, Homo sapiens
  Payload ID: 3152
  Gene Symbol: C14orf28
  Gene Name: chromosome 14 open reading frame 28
  ENSP ID: ENSP00000451791
MKTLFEEIKASIKNNYNQDRSFCRPVLPWGGVFTIKAGRKAVSCTPLYVEIRLKNTCTIDGFLMLLYVILNENENFPRELSLHFGREFVDCFLYLMDTYSFTTVKLLWIWDKMEKQQYKSEVHKASLIIDLFGNEHDNFTKNLENLMSTIQESYCSNWRCPTRVQEDQQRTINIKCGGLREFSQRIFCHGAPPFVVLNMQHWKSEDLAYVPYYLDLSDHKYLLEGATLFNKEEHHYSAAFQIGGHWMHYDGLRNVNLILLNKPPEFLLLSSLVYIRATEK

SEQ ID NO: 15853 - protein, 774 aa, Homo sapiens
  Payload ID: 3153
  Gene Symbol: C14orf37
  Gene Name: chromosome 14 open reading frame 37
  Uniprot ID: Q86TY3
  ENSP ID: ENSP00000267485
MRGPIVLHICLAFCSLLLFSVATQCLAFPKIERRREIAHVHAEKGQSDKMNTDDLENSSVTSKQTPQLVVSEDPMMMSAVPSATSLNKAFSINKETQPGQAGLMQTERPGVSTPTESGVPSAEEVFGSSQPERISPESGLAKAMLTIAITATPSLTVDEKEELLTSTNFQPIVEEITETTKGFLKYMDNQSFATESQEGVGLGHSPSSYVNTKEMLTTNPKTEKFEADTDHRTTSFPGAESTAGSEPGSLTPDKEKPSQMTADNTQAAATKQPLETSEYTLSVEPETDSLLGAPEVTVSVSTAVPAASALSDEWDDTKLESVSRIRTPKLGDNEETQVRTEMSQTAQVSHEGMEGGQPWTEAAQVALGLPEGETHTGTALLIAHGNERSPAFTDQSSFTPTSLMEDMKVSIVNLLQSTGDFTESTKENDALFFLETTVSVSVYESEADQLLGNTMKDIITQEMTTAVQEPDATLSMVTQEQVATLELIRDSGKTEEEKEDPSPVSDVPGVTQLSRRWEPLATTISTTVVPLSFEVTPTVEEQMDTVTGPNEEFTPVLGSPVTPPGIMVGEPSISPALPALEASSERRTVVPSITRVNTAASYGLDQLESEEGQEDEDEEDEEDEDEEEEDEEEDEEDKDADSLDEGLDGDTELPGFTLPGITSQEPGLEEGNMDLLEGATYQVPDALEWEQQNQGLVRSWMEKLKDKAGYMSGMLVPVGVGIAGALFILGALYSIKVMNRRRRNGFKRHKRKQREFNSMQDRVMLLADSSEDEF

SEQ ID NO: 15854 - protein, 97 aa, Homo sapiens
  Payload ID: 3153
  Gene Symbol: C14orf37
  Gene Name: chromosome 14 open reading frame 37
  ENSP ID: ENSP00000477692
  MOD_RES (1)..(1): Any amino acid
XVVPLSFEVTPTVEEQMDTVTGPNEEFTPVLGSPVTPPGIMVGEPSISPALPALEASSERRTVVPSITRVNTAASYGLDQLESEGIHALKGIFSRTG

SEQ ID NO: 15855 - protein, 587 aa, Homo sapiens
  Payload ID: 3154
  Gene Symbol: C14orf39
  Gene Name: chromosome 14 open reading frame 39
  Uniprot ID: Q8N1H7
  ENSP ID: ENSP00000324920
MNDSLFVSLDRLLLEFVFQYEQDISTKEEMIQRINKCCEDIKENKVTICRIHETINATDEEIDHYCKHSEEIKDNCRNWKPTCDVFRKHEDYMQDQFTVYQGTVEKDKEMYHDYICQYKEVLKQYQLKYSETPFSREYYEKKREHEEIQSRVLACTEQLKMNETIFMKFRVPAPFPSLTKWTLNIVNLRCETQDILKHASNLTKSSSELKKEVDEMEIEINYLNQQISRHNETKALSETLEEKNKNTENRKELKERIFGKDEHVLTLNKTQSSQLFLPYESQKLVRPIKMHSSEPRVADIKEESSAKQSKLANIDFRQKENDTQIFNDSAVDNHSKCSHITTITSSQKFMQVRLLTPQKQSNSNQWSEKGDKDAEYGDKGTVRQVRESKCTSQAIYTEHFGKSVENDSDEVEERAENFPRTSEIPIFLGTPKAVKAPESLEKIKFPKTPPFEINRNRNAVPEVQTEKESPGLSFLMSYTSRSPGLNLFDSSVFDTEISSDQFNEHYSARNLNPLSSEQEIGNLLEKPEGEDGFTFSFPSDTSTHTFGAGKDDFSFPFSFGQGQNSIPSSSLKGFSSSSQNTTQFTFF

SEQ ID NO: 15856 - protein, 37 aa, Homo sapiens
  Payload ID: 3154
  Gene Symbol: C14orf39
  Gene Name: chromosome 14 open reading frame 39
  ENSP ID: ENSP00000450476
MNDSLFVSLDRLLLEFVFQYEQDISTKEEMIQRINNI

SEQ ID NO: 15857 - protein, 88 aa, Homo sapiens
  Payload ID: 3154
  Gene Symbol: C14orf39
  Gene Name: chromosome 14 open reading frame 39
  ENSP ID: ENSP00000451441
MNDSLFVSLDRLLLEFVFQYEQDISTKEEMIQRINKCCEDIKENKVTICRIHETINATDEEIDHYCKHSEEIKDNCRNWKPTCDVFRK

SEQ ID NO: 15858 - protein, 114 aa, Homo sapiens
  Payload ID: 3154
  Gene Symbol: C14orf39
  Gene Name: chromosome 14 open reading frame 39
  ENSP ID: ENSP00000451665
MIQRINKCCEDIKENKVTICRIHETINATDEEIDHYCKHSEEIKDNCRNWKPTCDVFRKHEDYMQDQFTVYQGTVEKDKEMYHDYICQYKEVLKQYQLKYSETPFSREYYEKKR

SEQ ID NO: 15859 - protein, 72 aa, Homo sapiens
  Payload ID: 3154
  Gene Symbol: C14orf39
  Gene Name: chromosome 14 open reading frame 39
  ENSP ID: ENSP00000451937
  MOD_RES (1)..(1): Any amino acid
XNLFDSSVFDTEISSDQFNEHYSARNLNPLSSEQEIEKTKCFRNEGKKGHHELENLGRIHRRGKIELGLYSL

SEQ ID NO: 15860 - protein, 197 aa, Homo sapiens
  Payload ID: 3155
  Gene Symbol: C14orf79
  Gene Name: chromosome 14 open reading frame 79
  ENSP ID: ENSP00000374614
MQGRRELGGEPLSDLQEEAASASLRVAPERLSDDSLEWRRTCPDLLLSDGKASISMPREGGSTCTARCPDPGEHSSTWGEFEGFRESSAKSGQFSQSLELLEGPTEPQPPRTTSAPKECSSHQPCQGGPWVTGTSAVPPSEPILSYENILKCAFQEITVQQAAEDVSTIDHFLEISSEEKPGVERVHKLWDTLSTEH

SEQ ID NO: 15861 - protein, 219 aa, Homo sapiens
  Payload ID: 3155
  Gene Symbol: C14orf79
  Gene Name: chromosome 14 open reading frame 79
  ENSP ID: ENSP00000447512
  MOD_RES (1)..(1): Any amino acid
XTPLPGNGAAQAGGNGWLQVSLALVPRGPAEAATKPILSYENILKCAFQEITVQQAAEDVSTIDHFLEISSEEKPGVERVHKLCNESRKLWRALQSIHTTSTSQRLWSESRCQENFFLVLGIDAAQKNLSGGQGHIMEDCDLKEPEGLLTVSSFCLQHCKALIQTKLSGPPGSKQGRLMTCSRFLKTPSCGGGQHITIPRKRMFTPRKLKLTLFNSDVC

SEQ ID NO: 15862 - protein, 185 aa, Homo sapiens
  Payload ID: 3155
  Gene Symbol: C14orf79
  Gene Name: chromosome 14 open reading frame 79
  ENSP ID: ENSP00000447892
MQGRRELGGEPLSDLQEEAASASLRVAPERLSDDSLEWRRTCPDLLLSDGKASISMPREGGSTCTARCPDPGEHSSTWGEFEGFRESSAKSGQFSQSLELLEGPTEPQPPRTTSAPKECSSHQPCQGGPWVTGTSAVPPSEPILSYENILKCAFQEITVQQAAEDVSTIDHFLEISSEEKPGVER

SEQ ID NO: 15863 - protein, 83 aa, Homo sapiens
  Payload ID: 3155
  Gene Symbol: C14orf79
  Gene Name: chromosome 14 open reading frame 79
  ENSP ID: ENSP00000448642
MEDCDLKEPEGLLTVSSFCLQHCKALIQTKLSGPPGSKQGRLMTCSRFLKTPSCGGGQHITIPRKRMFTPRKLKLTLFNSDVC

SEQ ID NO: 15864 - protein, 325 aa, Homo sapiens
  Payload ID: 3155
  Gene Symbol: C14orf79
  Gene Name: chromosome 14 open reading frame 79
  Uniprot ID: Q96F83
  ENSP ID: ENSP00000450114
MQGRRELGGEPLSDLQEEAASASLRVAPERLSDDSLEWRRTCPDLLLSDGKASISMPREGGSTCTARCPDPGEHSSTWGEFEGFRESSAKSGQFSQSLELLEGPTEPQPPRTTSAPKECSSHQPCQGGPWVTGTSAVPPSEPILSYENILKCAFQEITVQQAAEDVSTIDHFLEISSEEKPGVERVHKLCNESRKLWRALQSIHTTSTSQRLWSESRCQENFFLVLGIDAAQKNLSGGQGHIMEDCDLKEPEGLLTVSSFCLQHCKALIQTKLSGPPGSKQGRLMTCSRFLKTPSCGGGQHITIPRKRMFTPRKLKLTLFNSDVC

SEQ ID NO: 15865 - protein, 83 aa, Homo sapiens; identical to SEQ ID NO: 15863
  Payload ID: 3155
  Gene Symbol: C14orf79
  Gene Name: chromosome 14 open reading frame 79
  ENSP ID: ENSP00000450135

SEQ ID NO: 15866 - protein, 354 aa, Homo sapiens
  Payload ID: 3156
  Gene Symbol: C14orf80
  Gene Name: chromosome 14 open reading frame 80
  Uniprot ID: Q86SX3
  ENSP ID: ENSP00000333010
MSGQRGDWVQTSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 15867 - protein, 248 aa, Homo sapiens
  Payload ID: 3156
  Gene Symbol: C14orf80
  Gene Name: chromosome 14 open reading frame 80
  Uniprot ID: Q86SX3
  ENSP ID: ENSP00000333959
MLAQARVPLGDEMTVCQIHLYTRGCHSDQSLSHLSVTEAEMLRDPEGGQQLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 15868 - protein, 393 aa, Homo sapiens
  Payload ID: 3156
  Gene Symbol: C14orf80
  Gene Name: chromosome 14 open reading frame 80
  Uniprot ID: Q86SX3
  ENSP ID: ENSP00000346568
MGRRRQRVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 15869 - protein, 426 aa, Homo sapiens
  Payload ID: 3156
  Gene Symbol: C14orf80
  Gene Name: chromosome 14 open reading frame 80
  Uniprot ID: Q86SX3
  ENSP ID: ENSP00000376307
MGRRRQRVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 15870 - protein, 495 aa, Homo sapiens
  Payload ID: 3156
  Gene Symbol: C14orf80
  Gene Name: chromosome 14 open reading frame 80
  Uniprot ID: Q86SX3
  ENSP ID: ENSP00000376308
MGRRRQRVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQVSGAGAAQNLDLAYPKCLHSFCTPGMGPRTFWNDLWLVCEQPGLLPGDWAAPLDPGGASACSLLSPFRALLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 15871 - protein, 352 aa, Homo sapiens
  Payload ID: 3156
  Gene Symbol: C14orf80
  Gene Name: chromosome 14 open reading frame 80
  Uniprot ID: Q86SX3
  ENSP ID: ENSP00000376312
MSGQRGDWTSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 15872 - protein, 80 aa, Homo sapiens
  Payload ID: 3156
  Gene Symbol: C14orf80
  Gene Name: chromosome 14 open reading frame 80
  ENSP ID: ENSP00000391365
MSGQRGDWTSALWQLLFRVLSPLPAGNALASLALEVQARLVKSALCSQGYPRLALAQLPEDGSQGSRELLLALSWLLARG

SEQ ID NO: 15873 - protein, 248 aa, Homo sapiens; identical to SEQ ID NO: 15867
  Payload ID: 3156
  Gene Symbol: C14orf80
  Gene Name: chromosome 14 open reading frame 80
  Uniprot ID: Q86SX3
  ENSP ID: ENSP00000391436

SEQ ID NO: 15874 - protein, 110 aa, Homo sapiens
  Payload ID: 3156
  Gene Symbol: C14orf80
  Gene Name: chromosome 14 open reading frame 80
  ENSP ID: ENSP00000398161
MSGQRGDWTSALWQLLFRVLSPLPAGNALASLALEVQARLVKSALCSQGYPRLALAQLPEDGSQGSRELLLALSWLLARGPVPEQMLAQARVPLGDEMTVCQCEALASPG

SEQ ID NO: 15875 - protein, 216 aa, Homo sapiens
  Payload ID: 3156
  Gene Symbol: C14orf80
  Gene Name: chromosome 14 open reading frame 80
  ENSP ID: ENSP00000399624
MSGQRGDWTSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWM

SEQ ID NO: 15876 - protein, 157 aa, Homo sapiens
  Payload ID: 3156
  Gene Symbol: C14orf80
  Gene Name: chromosome 14 open reading frame 80
  ENSP ID: ENSP00000400014
MLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWMDTVLGTCAPEVPAAASQPTFLPWVPE

SEQ ID NO: 15877 - protein, 302 aa, Homo sapiens
  Payload ID: 3156
  Gene Symbol: C14orf80
  Gene Name: chromosome 14 open reading frame 80
  ENSP ID: ENSP00000400604
MSGQRGDWTSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELG

SEQ ID NO: 15878 - protein, 54 aa, Homo sapiens
  Payload ID: 3156
  Gene Symbol: C14orf80
  Gene Name: chromosome 14 open reading frame 80
  ENSP ID: ENSP00000401319
MLAQARVPLGDEMTVCQCEALASPGPPAPHMEAEGPVDVRHVQWLMGKLRFRWR

SEQ ID NO: 15879 - protein, 119 aa, Homo sapiens
  Payload ID: 3156
  Gene Symbol: C14orf80
  Gene Name: chromosome 14 open reading frame 80
  ENSP ID: ENSP00000450003
MGRRRQRVDPAAGARAGALPEAIAALSRSLPSGPSPEIFRRAKFDRPEATSALWQLLFRVLSPLPAGNALATRGWHWHNYLRMARRAVGSCCWLCPGSWPEDLCPSRCWPRPECLWVTR

SEQ ID NO: 15880 - protein, 538 aa, Homo sapiens
  Payload ID: 3157
  Gene Symbol: C14orf93
  Gene Name: chromosome 14 open reading frame 93
  Uniprot ID: Q9H972
  ENSP ID: ENSP00000299088
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPGVWVARPPRFRAQRLTELCYHLDANSKHGTKANRVYGPPSDRLPSAEAQLLPPELYNPNFQEEEDEGGDENAPGSPSFDQPHKTCCPDLNSFIEIKVEKDE

SEQ ID NO: 15881 - protein, 498 aa, Homo sapiens
  Payload ID: 3157
  Gene Symbol: C14orf93
  Gene Name: chromosome 14 open reading frame 93
  Uniprot ID: Q9H972
  ENSP ID: ENSP00000341353
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPDRLPSAEAQLLPPELYNPNFQEEEDEGGDENAPGSPSFDQPHKTCCPDLNSFIEIKVEKDE

SEQ ID NO: 15882 - protein, 126 aa, Homo sapiens
  Payload ID: 3157
  Gene Symbol: C14orf93
  Gene Name: chromosome 14 open reading frame 93
  ENSP ID: ENSP00000380532
MRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLS

SEQ ID NO: 15883 - protein, 358 aa, Homo sapiens
  Payload ID: 3157
  Gene Symbol: C14orf93
  Gene Name: chromosome 14 open reading frame 93
  ENSP ID: ENSP00000380533
MRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPGVWVARPPRFRAQRLTELCYHLDANSKHGTKANRVYGPPSDRLPSAEAQLLPPELYNPNFQEEEDEGGDENAPGSPSFDQPHKTCCPDLNSFIEIKVEKDE

SEQ ID NO: 15884 - protein, 538 aa, Homo sapiens; identical to SEQ ID NO: 15880
  Payload ID: 3157
  Gene Symbol: C14orf93
  Gene Name: chromosome 14 open reading frame 93
  Uniprot ID: Q9H972
  ENSP ID: ENSP00000380535

SEQ ID NO: 15885 - protein, 208 aa, Homo sapiens
  Payload ID: 3157
  Gene Symbol: C14orf93
  Gene Name: chromosome 14 open reading frame 93
  ENSP ID: ENSP00000380536
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASE

SEQ ID NO: 15886 - protein, 538 aa, Homo sapiens; identical to SEQ ID NO: 15880
  Payload ID: 3157
  Gene Symbol: C14orf93
  Gene Name: chromosome 14 open reading frame 93
  Uniprot ID: Q9H972
  ENSP ID: ENSP00000380538

SEQ ID NO: 15887 - protein, 199 aa, Homo sapiens
  Payload ID: 3157
  Gene Symbol: C14orf93
  Gene Name: chromosome 14 open reading frame 93
  ENSP ID: ENSP00000450771
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNP

SEQ ID NO: 15888 - protein, 78 aa, Homo sapiens
  Payload ID: 3157
  Gene Symbol: C14orf93
  Gene Name: chromosome 14 open reading frame 93
  ENSP ID: ENSP00000450866
MSFSATILFSPPSGSEARCCCCACKSETNGGNTGSQGGNPPPSTPITVTGHGLAVQSSEQLLHVIYQRVDKAVGLAEA

SEQ ID NO: 15889 - protein, 106 aa, Homo sapiens
  Payload ID: 3157
  Gene Symbol: C14orf93
  Gene Name: chromosome 14 open reading frame 93
  ENSP ID: ENSP00000451111
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVS

SEQ ID NO: 15890 - protein, 9 aa, Homo sapiens
  Payload ID: 3157
  Gene Symbol: C14orf93
  Gene Name: chromosome 14 open reading frame 93
  ENSP ID: ENSP00000451155
MSFSATILF

SEQ ID NO: 15891 - protein, 83 aa, Homo sapiens
  Payload ID: 3157
  Gene Symbol: C14orf93
  Gene Name: chromosome 14 open reading frame 93
  ENSP ID: ENSP00000451456
MSFSATILFSPPSGSEARCCCCACKSETNGGNTGSQGGNPPPSTPITVTGHGLAVQSSEQLLHVIYQRVDKAVGLAEAALGLA

SEQ ID NO: 15892 - protein, 11 aa, Homo sapiens
  Payload ID: 3157
  Gene Symbol: C14orf93
  Gene Name: chromosome 14 open reading frame 93
  ENSP ID: ENSP00000451762
MSFSATILFSP

SEQ ID NO: 15893 - protein, 49 aa, Homo sapiens
  Payload ID: 3157
  Gene Symbol: C14orf93
  Gene Name: chromosome 14 open reading frame 93
  ENSP ID: ENSP00000451879
MSFSATILFSPPSGSEARCCCCACKSETNGGNTGSQGGNPPPSTPITVT

SEQ ID NO: 15894 - protein, 136 aa, Homo sapiens
  Payload ID: 3157
  Gene Symbol: C14orf93
  Gene Name: chromosome 14 open reading frame 93
  ENSP ID: ENSP00000452036
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFK

SEQ ID NO: 15895 - protein, 9 aa, Homo sapiens
  Payload ID: 3157
  Gene Symbol: C14orf93
  Gene Name: chromosome 14 open reading frame 93
  ENSP ID: ENSP00000452088
MSFSATILF

SEQ ID NO: 15896 - protein, 1047 aa, Homo sapiens
  Payload ID: 3158
  Gene Symbol: C15orf39
  Gene Name: chromosome 15 open reading frame 39
  Uniprot ID: Q6ZRI6
  ENSP ID: ENSP00000353854
MAEKRPLRTLGPVMYGKLPRLETDSGLEHSLPHSVGNQDPCTYKGSYFSCPMAGTPKAESEQLASWTPYPPLYSTGMAGPPLQADNLLTNCLFYRSPAEGPEKMQDSSPVELLPFSPQAHSYPGPPLAAPKPVYRNPLCYGLSTCLGEGAVKRPLDVDWTLATGPLLPSADPPCSLAPAPSKGQTLDGTFLRGVPAEGSSKDSSGSFSPCQPFLEKYQTIHSTGFLASRYTGPYPRNSKQAMSEGPSSPWTQLAQPLGPPCQDTGPTHYPPPHHPPPHPPQALPCPPACRHPEKQGSYSPALPLQPLGGHKGTGYQAGGLGSPYLRQQAAQAPYIPPLGLDAYPYPSAPLPAPSPGLKLEPPLTPRCPLDFAPQTLSFPYARDDLSLYGASPGLGGTPPSQNNVRAVPQPGAFQRACQPLPASQPCSEPVRPAQEAEEKTWLPSCRKEKLQPRLSEHSGPPIVIRDSPVPCTPPALPPCARECQSLPQKEGARPPSSPPMPVIDNVFSLAPYRDYLDVPAPEATTEPDSATAEPDSAPATSEGQDKGCRGTLPAQEGPSGSKPLRGSLKEEVALDLSVRKPTAEASPVKASRSVEHAKPTAAMDVPDVGNMVSDLPGLKKIDTEAPGLPGVPVTTDAMPRTNFHSSVAFMFRKFKILRPAPLPAAVVPSTPTSAPAPTQPAPTPTSGPIGLRILAQQPLSVTCFSLALPSPPAVAVASPAPAPAPSPAPARAQAPASARDPAPAPAPVAGPAPASTSAPGDSLEQHFTGLHASLCDAISGSVAHSPPEKLREWLETAGPWGQAAWQDCQGVQGLLAKLLSQLQRFDRTHRCPFPHVVRAGAIFVPIHLVKERLFPRLPPASVDHVLQEHRVELRPTTLSEERALRELALPGCTSRMLKLLALRQLPDIYPDLLGLQWRDCVRRQLGDFDTEAGAVSSSEPTVARGEPESLALAQKSPAPKVRKPGRKPPTPGPEKAEAAAGEESCGASPTPATSASPPGPTLKARFRSLLETAWLNGLALPTWGHKSSRPDQPSPCPQLLDSQSHHL

SEQ ID NO: 15897 - protein, 1047 aa, Homo sapiens; identical to SEQ ID NO: 15896
  Payload ID: 3158
  Gene Symbol: C15orf39
  Gene Name: chromosome 15 open reading frame 39
  Uniprot ID: Q6ZRI6
  ENSP ID: ENSP00000378438

SEQ ID NO: 15898 - protein, 807 aa, Homo sapiens
  Payload ID: 3158
  Gene Symbol: C15orf39
  Gene Name: chromosome 15 open reading frame 39
  ENSP ID: ENSP00000454405
  MOD_RES (1)..(1): Any amino acid
XVYRNPLCYGLSTCLGEGAVKRPLDVDWTLATGPLLPSADPPCSLAPAPSKGQTLDGTFLRGVPAEGSSKDSSGSFSPCQPFLEKYQTIHSTGFLASRYTGPYPRNSKQAMSEGPSSPWTQLAQPLGPPCQDTGPTHYPPPHHPPPHPPQALPCPPACRHPEKQGSYSPALPLQPLGGHKGTGYQAGGLGSPYLRQQAAQAPYIPPLGLDAYPYPSAPLPAPSPGLKLEPPLTPRCPLDFAPQTLSFPYARDDLSLYGASPGLGGTPPSQNNVRAVPQPGAFQRACQPLPASQPCSEPVRPAQEAEEKTWLPSCRKEKLQPRLSEHSGPPIVIRDSPVPCTPPALPPCARECQSLPQKEGARPPSSPPMPVIDNVFSLAPYRDYLDVPAPEATTEPDSATAEPDSAPATSEGQDKGCRGTLPAQEGPSGSKPLRGSLKEEVALDLSVRKPTAEASPVKASRSVEHAKPTAAMDVPDVGNMVSDLPGLKKIDTEAPGLPGVPVTTDAMPRTNFHSSVAFMFRKFKILRPAPLPAAVVPSTPTSAPAPTQPAPTPTSGPIGLRILAQQPLSVTCFSLALPSPPAVAVASPAPAPAPSPAPARAQAPASARDPAPAPAPVAGPAPASTSAPGDSLEQHFTGLHASLCDAISGSVAHSPPEKLREWLETAGPWGQAAWQDCQGVQGLLAKLLSQLQRFDRTHRCPFPHVVRAGAIFVPIHLVKERLFPRLPPASVDHVLQEHRVELRPTTLSEERALRELALPGCTSRMLKLLALRQLPDIYPDLLGLQWRDCVRRQLGEHGAAPVATGAV

SEQ ID NO: 15899 - protein, 21 aa, Homo sapiens
  Payload ID: 3158
  Gene Symbol: C15orf39
  Gene Name: chromosome 15 open reading frame 39
  ENSP ID: ENSP00000454677
MAEKRPLRTLGPVMYGKLPRL

SEQ ID NO: 15900 - protein, 27 aa, Homo sapiens
  Payload ID: 3158
  Gene Symbol: C15orf39
  Gene Name: chromosome 15 open reading frame 39
  ENSP ID: ENSP00000456381
MAEKRPLRTLGPVMYGKLPRLETDSGL

SEQ ID NO: 15901 - protein, 29 aa, Homo sapiens
  Payload ID: 3158
  Gene Symbol: C15orf39
  Gene Name: chromosome 15 open reading frame 39
  ENSP ID: ENSP00000457045
MAEKRPLRTLGPVMYGKLPRLETDSGLEH

SEQ ID NO: 15902 - protein, 938 aa, Homo sapiens
  Payload ID: 3158
  Gene Symbol: C15orf39
  Gene Name: chromosome 15 open reading frame 39
  Uniprot ID: Q6ZRI6
  ENSP ID: ENSP00000458025
MAEKRPLRTLGPVMYGKLPRLETDSGLEHSLPHSVGNQDPCTYKGSYFSCPMAGTPKAESEQLASWTPYPPLYSTGMAGPPLQADNLLTNCLFYRSPAEGPEKMQDSSPVELLPFSPQAHSYPGPPLAAPKPVYRNPLCYGLSTCLGEGAVKRPLDVDWTLATGPLLPSADPPCSLAPAPSKGQTLDGTFLRGVPAEGSSKDSSGSFSPCQPFLEKYQTIHSTGFLASRYTGPYPRNSKQAMSEGPSSPWTQLAQPLGPPCQDTGPTHYPPPHHPPPHPPQALPCPPACRHPEKQGSYSPALPLQPLGGHKGTGYQAGGLGSPYLRQQAAQAPYIPPLGLDAYPYPSAPLPAPSPGLKLEPPLTPRCPLDFAPQTLSFPYARDDLSLYGASPGLGGTPPSQNNVRAVPQPGAFQRACQPLPASQPCSEPVRPAQEAEEKTWLPSCRKEKLQPRLSEHSGPPIVIRDSPVPCTPPALPPCARECQSLPQKEGARPPSSPPMPVIDNVFSLAPYRDYLDVPAPEATTEPDSATAEPDSAPATSEGQDKGCRGTLPAQEGPSGSKPLRGSLKEEVALDLSVRKPTAEASPVKASRSVEHAKPTAAMDVPDVGNMVSDLPGLKKIDTEAPGLPGVPVTTDAMPRTNFHSSVAFMFRKFKILRPAPLPAAVVPSTPTSAPAPTQPAPTPTSGPIGLRILAQQPLSVTCFSLALPSPPAVAVASPAPAPAPSPAPARAQAPASARDPAPAPAPVAGPAPASTSAPGDSLEQHFTGLHASLCDAISGSVAHSPPEKLREWLETAGPWGQAAWQDCQGVQGLLAKLLSQLQRFDRTHRCPFPHVVRAGAIFVPIHLVKERLFPRLPPASVDHVLQEHRVELRPTTLSEERALRELALPGCTSRMLKLLALRQLPDIYPDLLGLQWRDCVRRQLGEHGAAPVATGAV

SEQ ID NO: 15903 - protein, 153 aa, Homo sapiens
  Payload ID: 3159
  Gene Symbol: C15orf40
  Gene Name: chromosome 15 open reading frame 40
  Uniprot ID: Q8WUR7
  ENSP ID: ENSP00000307071
MLRLRSGLRHLRATPNTRGSARLLCAEMPKKAGATTKGKSQSKEPERPLPPLGPVAVDPKGCVTIAIHAKPGSKQNAVTDLTAEAVNVAIAAPPSEGEANAELCRYLSKVLELRKSDVVLDKGGKSREKVVKLLASTTPEEILEKLKKEAKKT

SEQ ID NO: 15904 - protein, 167 aa, Homo sapiens
  Payload ID: 3159
  Gene Symbol: C15orf40
  Gene Name: chromosome 15 open reading frame 40
  Uniprot ID: Q8WUR7
  ENSP ID: ENSP00000403987
MLRLRSGLRHLRATPNTRGSARLLCAEMPKKAGATTKGKSQSKEPERPLPPLGPVAVDPKGCVTIAIHAKPGSKQNAVTDLTAEAVNVAIAAPPSEGEANAELCRYLSKVLELRKSDVVLDKTGSCYIAQAGLELLASSDLPASASQSAGITGVSHHTQPALLLISL

SEQ ID NO: 15905 - protein, 95 aa, Homo sapiens
  Payload ID: 3159
  Gene Symbol: C15orf40
  Gene Name: chromosome 15 open reading frame 40
  ENSP ID: ENSP00000423436
LRLRSGLRHLRATPNTRGSARLLCAEMPKKAGATTKGKSQSKEPERPLPPLGPVAVDPKGCVTIAIHAKPGSKQNAVTALLFHSSTIGGDSGGRF

SEQ ID NO: 15906 - protein, 36 aa, Homo sapiens
  Payload ID: 3159
  Gene Symbol: C15orf40
  Gene Name: chromosome 15 open reading frame 40
  ENSP ID: ENSP00000424167
  MOD_RES (1)..(1): Any amino acid
XARLLCAEMPKKAGATTKASSRVKARARNQRDHFLP

SEQ ID NO: 15907 - protein, 85 aa, Homo sapiens
  Payload ID: 3159
  Gene Symbol: C15orf40
  Gene Name: chromosome 15 open reading frame 40
  ENSP ID: ENSP00000426639
NAELCRYLSKVLELRKSDVVLDKGLSLCHPGWSTAAQPRVTAALTSLAQTILPPQPPKLLELQVHATHTRLIFVFFEETGSRHVA

SEQ ID NO: 15908 - protein, 149 aa, Homo sapiens
  Payload ID: 3159
  Gene Symbol: C15orf40
  Gene Name: chromosome 15 open reading frame 40
  Uniprot ID: Q8WUR7
  ENSP ID: ENSP00000441077
MLRLRSGLRHLRATPNTRGSARLLCAEMPKKAGATTKGKSQSKEPERPLPPLGPVAVDPKGCVTIAIHAKPGSKQNAVTDLTAEAVNVAIAAPPSEGEANAELCRYLSKVLELRKSDVVLDKLCYSIPQQLEETQEGVSGIPDTPCHFL

SEQ ID NO: 15909 - protein, 34 aa, Homo sapiens
  Payload ID: 3159
  Gene Symbol: C15orf40
  Gene Name: chromosome 15 open reading frame 40
  ENSP ID: ENSP00000454276
  MOD_RES (1)..(1): Any amino acid
XLLCAEMPKKAGATTKASSRVKARARNQRDHFLP

SEQ ID NO: 15910 - protein, 146 aa, Homo sapiens
  Payload ID: 3159
  Gene Symbol: C15orf40
  Gene Name: chromosome 15 open reading frame 40
  ENSP ID: ENSP00000454502
  MOD_RES (1)..(1): Any amino acid
XRHLRATPNTRGSARLLCAEMPKKAGATTKGKSQSKEPERPLPPLGPVAVDPKGCVTIAIHAKPGSKQNAVTDLTAEAVNVAIAAPPSEGEANAELCRYLSKVLELRKSDVVLDKKLRDLLKIVPCKLATRTQILGLLVECSFSRL

SEQ ID NO: 15911 - protein, 68 aa, Homo sapiens
  Payload ID: 3159
  Gene Symbol: C15orf40
  Gene Name: chromosome 15 open reading frame 40
  ENSP ID: ENSP00000456006
MLRLRSGLRHLRATPNTRGSARLLCAEMPKKAGATTKGGKSREKVVKLLASTTPEEILEKLKKEAKKT

SEQ ID NO: 15912 - protein, 183 aa, Homo sapiens
  Payload ID: 3160
  Gene Symbol: C15orf41
  Gene Name: chromosome 15 open reading frame 41
  Uniprot ID: Q9Y2V0
  ENSP ID: ENSP00000342433
MARLILERFLQEHEETPPSKSIINSMLRDPSQIPDGVLANQVYQCIVNDCCYGPLVDCIKHAIGHEHEVLLRDLLLEKNLSFLDEDQLRAKGYDKTPDFILQVPVAVEGHIIHWIESKASFGDECSHHAYLHDQFWSYWNRFGPGLVIYWYGFIQELDCNRERGILLKACFPTNIVTLCHSIA

SEQ ID NO: 15913 - protein, 281 aa, Homo sapiens
  Payload ID: 3160
  Gene Symbol: C15orf41
  Gene Name: chromosome 15 open reading frame 41
  Uniprot ID: Q9Y2V0
  ENSP ID: ENSP00000401362
MILTKAQYDEIAQCLVSVPPTRQSLRKLKQRFPSQSQATLLSIFSQEYQKHIKRTHAKHHTSEAIESYYQRYLNGVVKNGAAPVLLDLANEVDYAPSLMARLILERFLQEHEETPPSKSIINSMLRDPSQIPDGVLANQVYQCIVNDCCYGPLVDCIKHAIGHEHEVLLRDLLLEKNLSFLDEDQLRAKGYDKTPDFILQVPVAVEGHIIHWIESKASFGDECSHHAYLHDQFWSYWNRFGPGLVIYWYGFIQELDCNRERGILLKACFPTNIVTLCHSIA

SEQ ID NO: 15914 - protein, 105 aa, Homo sapiens
  Payload ID: 3160
  Gene Symbol: C15orf41
  Gene Name: chromosome 15 open reading frame 41
  ENSP ID: ENSP00000454334
MSVAENEDQLRAKGYDKTPDFILQVPVAVEGHIIHWIESKASFGDECSHHAYLHDQFWSYWNRFGPGLVIYWYGFIQELDCNRERGILLKACFPTNIVTLCHSIA

SEQ ID NO: 15915 - protein, 122 aa, Homo sapiens
  Payload ID: 3160
  Gene Symbol: C15orf41
  Gene Name: chromosome 15 open reading frame 41
  ENSP ID: ENSP00000454831
MARLILERFLQEHEETPPSKSIINSMLRDPSQIPDGVLANQVYQCIVNDCCYGPLVDCIKHAIGHEHEVLLRDLLLEKNLSFLDEDQLRAKGYDKTPDFILQVPVAVEGHIIHWIESKASFG

SEQ ID NO: 15916 - protein, 281 aa, Homo sapiens; identical to SEQ ID NO: 15913
  Payload ID: 3160
  Gene Symbol: C15orf41
  Gene Name: chromosome 15 open reading frame 41
  Uniprot ID: Q9Y2V0
  ENSP ID: ENSP00000455397

SEQ ID NO: 15917 - protein, 66 aa, Homo sapiens
  Payload ID: 3160
  Gene Symbol: C15orf41
  Gene Name: chromosome 15 open reading frame 41
  ENSP ID: ENSP00000456240
MIWARLSHLLVWIYPGAGLQPGKGHPAQSLFPHEHCHLMPQHSLTLKILEEKLGGKETQHCITIVE

SEQ ID NO: 15918 - protein, 287 aa, Homo sapiens
  Payload ID: 3160
  Gene Symbol: C15orf41
  Gene Name: chromosome 15 open reading frame 41
  ENSP ID: ENSP00000456477
MILTKAQYDEIAQCLVSVPPTRQSLRKLKQRFPSQSQATLLSIFSQEYQKHIKRTHAKHHTSEAIESYYQRYLNGVVKNGAAPVLLDLANEVDYAPSLMARLILERFLQEHEETPPSKSIINSMLRDPSQIPDGVLANQVYQCIVNDCCYGPLVDCIKHAIGHEHEVLLRDLLLEKNLSFLDEDQLRAKGYDKTPDFILQVPVVMLCPLAVEGHIIHWIESKASFGDECSHHAYLHDQFWSYWNRFGPGLVIYWYGFIQELDCNRERGILLKACFPTNIVTLCHSIA

SEQ ID NO: 15919 - protein, 183 aa, Homo sapiens; identical to SEQ ID NO: 15912
  Payload ID: 3160
  Gene Symbol: C15orf41
  Gene Name: chromosome 15 open reading frame 41
  Uniprot ID: Q9Y2V0
  ENSP ID: ENSP00000456736

SEQ ID NO: 15920 - protein, 101 aa, Homo sapiens
  Payload ID: 3160
  Gene Symbol: C15orf41
  Gene Name: chromosome 15 open reading frame 41
  ENSP ID: ENSP00000457227
MILTKAQYDEIAQCLVSVPPTRQSLRKLKQRFPRYLNGVVKNGAAPVLLDLANEVDYAPSLMARLILERFLQEHEETPPSKSIINSMLRDPSQIPDGVLAN

SEQ ID NO: 15921 - protein, 183 aa, Homo sapiens; identical to SEQ ID NO: 15912
  Payload ID: 3160
  Gene Symbol: C15orf41
  Gene Name: chromosome 15 open reading frame 41
  Uniprot ID: Q9Y2V0
  ENSP ID: ENSP00000457854

SEQ ID NO: 15922 - protein, 220 aa, Homo sapiens
  Payload ID: 3161
  Gene Symbol: C15orf43
  Gene Name: chromosome 15 open reading frame 43
  Uniprot ID: Q8NHR7
  ENSP ID: ENSP00000340644
MFQGQRGWFCGSVSQDLRQFWVAEGGTISDPRAADFLFSCDASHPDTLRIYQSLDYIEDNATVFHAYYLSAVANAKIKNSVALGHFILPPACLQKEIRRKIGSFIWEQDQHFLIEKHDEVTPNEIKTLRENSELATEHKKELSKSPEKHFIRTPVVEKQMYFPLQNYPVNNMVTGYISIDAMKKFLGELHDFIPGTSGYLAYHVQNEINMSAIKNKLKRK

SEQ ID NO: 15923 - protein, 43 aa, Homo sapiens
  Payload ID: 3161
  Gene Symbol: C15orf43
  Gene Name: chromosome 15 open reading frame 43
  ENSP ID: ENSP00000452951
  MOD_RES (1)..(1): Any amino acid
XGWFCGSVSQDLRQFWGRKLSGSSGLGGEGSILLSLMLWVQGA

SEQ ID NO: 15924 - protein, 48 aa, Homo sapiens
  Payload ID: 3161
  Gene Symbol: C15orf43
  Gene Name: chromosome 15 open reading frame 43
  ENSP ID: ENSP00000454013
MFQGQRGWFCGSVSQDLRQFWGRKLSGSSGLGGEGSILLSLMLWVQGA

SEQ ID NO: 15925 - protein, 83 aa, Homo sapiens
  Payload ID: 3162
  Gene Symbol: C15orf48
  Gene Name: chromosome 15 open reading frame 48
  Uniprot ID: Q9C002
  ENSP ID: ENSP00000341610
MSFFQLLMKRKELIPLVVFMTVAAGGASSFAVYSLWKTDVILDRKKNPEPWETVDPTVPQKLITINQQWKPIEELQNVQRVTK

SEQ ID NO: 15926 - protein, 83 aa, Homo sapiens; identical to SEQ ID NO: 15925
  Payload ID: 3162
  Gene Symbol: C15orf48
  Gene Name: chromosome 15 open reading frame 48
  Uniprot ID: Q9C002
  ENSP ID: ENSP00000379887

SEQ ID NO: 15927 - protein, 132 aa, Homo sapiens
  Payload ID: 3162
  Gene Symbol: C15orf48
  Gene Name: chromosome 15 open reading frame 48
  ENSP ID: ENSP00000452967
MSFFQLLMKRKELIPLVVFMTVAAGGASSFAVYSLWKTDVILDRKKNPEPWETVDPTVPQKVSAPAYCKLGAFLLQNPCPLARKPWNFPRSLRQLQATGRSQMVRKGMNLKEEEPALPTLSGAPPKGTGKLH

SEQ ID NO: 15928 - protein, 324 aa, Homo sapiens
  Payload ID: 3163
  Gene Symbol: C15orf52
  Gene Name: chromosome 15 open reading frame 52
  Uniprot ID: Q6ZUT6
  ENSP ID: ENSP00000380670
MRHREGSWEPWSRPVGEPPEAGWDYAQWKQEREQIDLARLARHRDAQGDWRRPWDLDKAKSTLQDCSQLRGEGPARAGSRRGPRSHQKLQPPPLLPDGKGRGGQASRPSVAPATGSKARGKERLTGRARRWDMKEDKEELEGQEGSQSTRETPSEEEQAQKQSGMEQGRLGSAPAASPALASPEGPKGESVASTASSVPCSPQEPDLAPLDLSLGGAGIPGPRESGCVLGLRPGAQESPVSWPEGSKQQPLGWSNHQAELEVQTCPEPQRGAGLPEPGEDRSGKSGAQQGLAPRSRPTRGGSQRSRGTAGVRRRTGRPGPAGRC

SEQ ID NO: 15929 - protein, 34 aa, Homo sapiens
  Payload ID: 3163
  Gene Symbol: C15orf52
  Gene Name: chromosome 15 open reading frame 52
  ENSP ID: ENSP00000452677
MKEDKEELEGQEGSQSTRETPSEEEQAQKQSGME

SEQ ID NO: 15930 - protein, 173 aa, Homo sapiens
  Payload ID: 3163
  Gene Symbol: C15orf52
  Gene Name: chromosome 15 open reading frame 52
  ENSP ID: ENSP00000453500
MSRQEKDAELDRRIVALRKKNQALLRRYQEIQEDRRQAEQGGMAVTTPALLQPDGLTVTISQVPGEKRVVSRNWARGTCGPRVTNEMLEDEDAEDHGGTFCLGELVELAVTMENKAEGKRIVSEKPTRARNQGIEGSPGGRVTRSPPTQVAISSDSARKGSWEPWSRPVGEPP

SEQ ID NO: 15931 - protein, 534 aa, Homo sapiens
  Payload ID: 3163
  Gene Symbol: C15orf52
  Gene Name: chromosome 15 open reading frame 52
  Uniprot ID: Q6ZUT6
  ENSP ID: ENSP00000453969
MISCAEQRSRQGEAGRGPAPVAPAFLPLWLPRGCSGILSVPAVAMHSAGTPRAESPMSRQEKDAELDRRIVALRKKNQALLRRYQEIQEDRRQAEQGGMAVTTPALLQPDGLTVTISQVPGEKRVVSRNWARGTCGPRVTNEMLEDEDAEDHGGTFCLGELVELAVTMENKAEGKRIVSEKPTRARNQGIEGSPGGRVTRSPPTQVAISSDSARKGSWEPWSRPVGEPPEAGWDYAQWKQEREQIDLARLARHRDAQGDWRRPWDLDKAKSTLQDCSQLRGEGPARAGSRRGPRSHQKLQPPPLLPDGKGRGGQASRPSVAPATGSKARGKERLTGRARRWDMKEDKEELEGQEGSQSTRETPSEEEQAQKQSGMEQGRLGSAPAASPALASPEGPKGESVASTASSVPCSPQEPDLAPLDLSLGGAGIPGPRESGCVLGLRPGAQESPVSWPEGSKQQPLGWSNHQAELEVQTCPEPQRGAGLPEPGEDRSGKSGAQQGLAPRSRPTRGGSQRSRGTAGVRRRTGRPGPAGRC

SEQ ID NO: 15932 - protein, 179 aa, Homo sapiens
  Payload ID: 3164
  Gene Symbol: C15orf53
  Gene Name: chromosome 15 open reading frame 53
  Uniprot ID: Q8NAA6
  ENSP ID: ENSP00000325144
MELQGAQEDLGISLSSPRRNHETRPGSKAKGRSSICLQASVWMAGGKLRLRASEHLTQGHQQELRDWNLGEDASLLFSKSPFGAGKLIQAPAHVFRQCWVQGNAWISCITKFDSKRSPEVASSPSYLTVPRRSPLPVFLRPSDRCVCGGCYLGKSTRRRACQSLLSDPLGVTFPTQTRP

SEQ ID NO: 15933 - protein, 185 aa, Homo sapiens
  Payload ID: 3165
  Gene Symbol: C15orf57
  Gene Name: chromosome 15 open reading frame 57
  Uniprot ID: Q9BV29
  ENSP ID: ENSP00000350695
MKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDESTLEHFKRWLQPDKVAVSTEEVQYLIPPESQVEKPVAEDEPAAGDKPAAAEQ

SEQ ID NO: 15934 - protein, 185 aa, Homo sapiens; identical to SEQ ID NO: 15933
  Payload ID: 3165
  Gene Symbol: C15orf57
  Gene Name: chromosome 15 open reading frame 57
  Uniprot ID: Q9BV29
  ENSP ID: ENSP00000397515

SEQ ID NO: 15935 - protein, 134 aa, Homo sapiens
  Payload ID: 3165
  Gene Symbol: C15orf57
  Gene Name: chromosome 15 open reading frame 57
  Uniprot ID: Q9BV29
  ENSP ID: ENSP00000452657
MKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDER

SEQ ID NO: 15936 - protein, 194 aa, Homo sapiens
  Payload ID: 3165
  Gene Symbol: C15orf57
  Gene Name: chromosome 15 open reading frame 57
  Uniprot ID: Q9BV29
  ENSP ID: ENSP00000452773
MRGSGLRFQMKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDESTLEHFKRWLQPDKVAVSTEEVQYLIPPESQVEKPVAEDEPAAGDKPAAAEQ

SEQ ID NO: 15937 - protein, 173 aa, Homo sapiens
  Payload ID: 3165
  Gene Symbol: C15orf57
  Gene Name: chromosome 15 open reading frame 57
  ENSP ID: ENSP00000453221
MKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDERPCNSRTPGSSSFSEDGAWDSHQCAEQRWRRTFPAQQSSW

SEQ ID NO: 15938 - protein, 185 aa, Homo sapiens; identical to SEQ ID NO: 15933
  Payload ID: 3165
  Gene Symbol: C15orf57
  Gene Name: chromosome 15 open reading frame 57
  Uniprot ID: Q9BV29
  ENSP ID: ENSP00000453226

SEQ ID NO: 15939 - protein, 84 aa, Homo sapiens
  Payload ID: 3165
  Gene Symbol: C15orf57
  Gene Name: chromosome 15 open reading frame 57
  ENSP ID: ENSP00000453274
MLRTLAQAKKECWDRFLQEKLASEFFVDGLDSDESTLEHFKRWLQPDKVAVSTEEVQYLIPPESQVEKPVAEDEPAAGDKPAAA

SEQ ID NO: 15940 - protein, 149 aa, Homo sapiens
  Payload ID: 3165
  Gene Symbol: C15orf57
  Gene Name: chromosome 15 open reading frame 57
  ENSP ID: ENSP00000453429
MKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDESFLRNGICAKGFGQAS

SEQ ID NO: 15941 - protein, 203 aa, Homo sapiens
  Payload ID: 3165
  Gene Symbol: C15orf57
  Gene Name: chromosome 15 open reading frame 57
  ENSP ID: ENSP00000453544
MKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDERPCNSRTPGSSSFSEDGAWDSHQCAEQRWRRTFPAQQSSWHGLGKIKSLNPRPHRYQVADHTAKPSDPDI

SEQ ID NO: 15942 - protein, 185 aa, Homo sapiens; identical to SEQ ID NO: 15933
  Payload ID: 3165
  Gene Symbol: C15orf57
  Gene Name: chromosome 15 open reading frame 57
  Uniprot ID: Q9BV29
  ENSP ID: ENSP00000453607

SEQ ID NO: 15943 - protein, 170 aa, Homo sapiens
  Payload ID: 3165
  Gene Symbol: C15orf57
  Gene Name: chromosome 15 open reading frame 57
  ENSP ID: ENSP00000453899
MKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDESTLEHFKRWLQPDKVAVSTEEVQYLIPPESQVEKPVA

SEQ ID NO: 15944 - protein, 134 aa, Homo sapiens; identical to SEQ ID NO: 15935
  Payload ID: 3165
  Gene Symbol: C15orf57
  Gene Name: chromosome 15 open reading frame 57
  Uniprot ID: Q9BV29
  ENSP ID: ENSP00000454049

SEQ ID NO: 15945 - protein, 173 aa, Homo sapiens; identical to SEQ ID NO: 15937
  Payload ID: 3165
  Gene Symbol: C15orf57
  Gene Name: chromosome 15 open reading frame 57
  ENSP ID: ENSP00000486892

SEQ ID NO: 15946 - protein, 293 aa, Homo sapiens
  Payload ID: 3166
  Gene Symbol: C15orf59
  Gene Name: chromosome 15 open reading frame 59
  Uniprot ID: Q2T9L4
  ENSP ID: ENSP00000369150
MNIRGAPDLGQPSDDPSSGGERERIRQRMKMVIGQLEGILRELKEVAKELREVVSQIDKLTSDFDFELEPDDWTTATVSSTSSSDKAGMGGPFDLGHLDFMTADILSDSWEFCSFLDVSTPSDSVDGPESTRPGAGPDYRLMNGGTPIPNGPRVETPDSSSEEAFGAGPTVKSQLPQRTPGTRERVRFSDKVLYHALCCDDEEGDGEQEVEEEEVGLPPEPAHTEAHAGPHKPSPAPYKSRRSPLTSRHSGSTLAPEQTRRVTRNSSTQTVSDKSTQTVLPYTATRQKARGKN

SEQ ID NO: 15947 - protein, 153 aa, Homo sapiens
  Payload ID: 3166
  Gene Symbol: C15orf59
  Gene Name: chromosome 15 open reading frame 59
  ENSP ID: ENSP00000452799
MKMVIGQLEGILRELKEVAKELREVVSQIDKLTSDFDFELEPDDWTTATVSSTSSSDKAGMGGPFDLGHLDFMTADILSDSWEFCSFLDVSTPSDSVDGPESTRPGAGPDYRLMNGGTPIPNGPRVETPDSSSEEAFGAGPTVKSQLPQRTPG

SEQ ID NO: 15948 - protein, 293 aa, Homo sapiens; identical to SEQ ID NO: 15946
  Payload ID: 3166
  Gene Symbol: C15orf59
  Gene Name: chromosome 15 open reading frame 59
  Uniprot ID: Q2T9L4
  ENSP ID: ENSP00000457205

SEQ ID NO: 15949 - protein, 157 aa, Homo sapiens
  Payload ID: 3167
  Gene Symbol: C15orf61
  Gene Name: chromosome 15 open reading frame 61
  Uniprot ID: A6NNL5
  ENSP ID: ENSP00000342254
MEALRRAHEVALRLLLCRPWASRAAARPKPSASEVLTRHLLQRRLPHWTSFCVPYSAVRNDQFGLSHFNWPVQGANYHVLRTGCFPFIKYHCSKAPWQDLARQNRFFTALKVVNLGIPTLLYGLGSWLFARVTETVHTSYGPITVYFLNKEDEGAMY

SEQ ID NO: 15950 - protein, 60 aa, Homo sapiens
  Payload ID: 3167
  Gene Symbol: C15orf61
  Gene Name: chromosome 15 open reading frame 61
  ENSP ID: ENSP00000453824
MFTVTRCLFSFGLMTEEGGIPTLLYGLGSWLFARVTETVHTSYGPITVYFLNKEDEGAMY

SEQ ID NO: 15951 - protein, 175 aa, Homo sapiens
  Payload ID: 3168
  Gene Symbol: C15orf62
  Gene Name: chromosome 15 open reading frame 62
  Uniprot ID: A8K5M9
  ENSP ID: ENSP00000341178
METWRKGSFRNASFFKQLSLGRPRRLRRQSSVLSQASTAGGDHEEYSNREVIRELQGRPDGRRLPLWGDEQPRATLLAPPKPPRLYRESSSCPNILEPPPAYTAAYSATLPSALSLSSALHQHSEKGLVDTPCFQRTPTPDLSDPFLSFKVDLGISLLEEVLQMLREQFPSEPSF

SEQ ID NO: 15952 - protein, 121 aa, Homo sapiens
  Payload ID: 3169
  Gene Symbol: C15orf65
  Gene Name: chromosome 15 open reading frame 65
  Uniprot ID: H3BRN8
  ENSP ID: ENSP00000456337
MTDRNRDKKSTSPSNSDTEMKSEQLPPCVNPGNPVFSCMLDPKTLQTATSLSKPQMIMYKTNSSHYGEFLPIPQFFPCNYTPKEQVFSSHIRATGFYQNNTLNTAPDRTRTLDFPNIQHTL

SEQ ID NO: 15953 - protein, 127 aa, Homo sapiens
  Payload ID: 3170
  Gene Symbol: C16orf13
  Gene Name: chromosome 16 open reading frame 13
  Uniprot ID: Q96S19
  ENSP ID: ENSP00000440475
MLVAAAAERNKDPILHVLRQYLDPAQRGVRVLEVASGSGQHAAHFARAFPLAEWQPSDVDQRCLDRGSSEQQDTCSNPGPCSSPTGNPEWGLRDTALLEDLGKASGLLLERMVDMPANNKCLIFRKN

SEQ ID NO: 15954 - protein, 205 aa, Homo sapiens
  Payload ID: 3170
  Gene Symbol: C16orf13
  Gene Name: chromosome 16 open reading frame 13
  Uniprot ID: Q96S19
  ENSP ID: ENSP00000440765
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEGLFRAAGHLLKPRALLITYGEPRMGASGHSPPGGPGKGQWPAPGEDGGHASQQQMPDLPEKLSPSFTPAHLHPCRRLCEARTLPP

SEQ ID NO: 15955 - protein, 107 aa, Homo sapiens
  Payload ID: 3170
  Gene Symbol: C16orf13
  Gene Name: chromosome 16 open reading frame 13
  Uniprot ID: Q96S19
  ENSP ID: ENSP00000444140
MLVAAAAERNKDPILHVLRQYLDPAQRGVRVLEVASGSGQHAAHFARAFPLAEWQPSDVDQRCLDRNPEWGLRDTALLEDLGKASGLLLERMVDMPANNKCLIFRKN

SEQ ID NO: 15956 - protein, 185 aa, Homo sapiens
  Payload ID: 3170
  Gene Symbol: C16orf13
  Gene Name: chromosome 16 open reading frame 13
  Uniprot ID: Q96S19
  ENSP ID: ENSP00000444460
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEEPRMGASGHSPPGGPGKGQWPAPGEDGGHASQQQMPDLPEKLSPSFTPAHLHPCRRLCEARTLPP

SEQ ID NO: 15957 - protein, 204 aa, Homo sapiens
  Payload ID: 3170
  Gene Symbol: C16orf13
  Gene Name: chromosome 16 open reading frame 13
  Uniprot ID: Q96S19
  ENSP ID: ENSP00000445926
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEGLFRAAGHLLKPRALLITYGPYAINGKISPQSNVDFDLMLRCRNPEWGLRDTALLEDLGKASGLLLERMVDMPANNKCLIFRKN

SEQ ID NO: 15958 - protein, 176 aa, Homo sapiens
  Payload ID: 3170
  Gene Symbol: C16orf13
  Gene Name: chromosome 16 open reading frame 13
  ENSP ID: ENSP00000454359
LRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEGLFRAAGHLLKPRALLITYGGGGALSFSKPQPASLSQALWEIPRPWSSGLCPHAHSPMPSMGRSPPRATWTLT

SEQ ID NO: 15959 - protein, 174 aa, Homo sapiens
  Payload ID: 3170
  Gene Symbol: C16orf13
  Gene Name: chromosome 16 open reading frame 13
  ENSP ID: ENSP00000454764
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEVCGEPSMGVCRGTTHPAWGQLGCQICPHHSRGALQSSRTPAQTQGPAHHLRALC

SEQ ID NO: 15960 - protein, 162 aa, Homo sapiens
  Payload ID: 3170
  Gene Symbol: C16orf13
  Gene Name: chromosome 16 open reading frame 13
  ENSP ID: ENSP00000454993
  MOD_RES (1)..(1): Any amino acid
XQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEGLFRAAGHLLKPRALLITYGEPRMGASGHSPPGGPGKGQWPAPGEDGRWGSGGPGNLSRG

SEQ ID NO: 15961 - protein, 161 aa, Homo sapiens
  Payload ID: 3170
  Gene Symbol: C16orf13
  Gene Name: chromosome 16 open reading frame 13
  ENSP ID: ENSP00000455614
KDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEVCGEPSMGVCRGTTHPAWGQLGCQICPHHSRGTQNGGFGTQPSWRTWERPV

SEQ ID NO: 15962 - protein, 133 aa, Homo sapiens
  Payload ID: 3170
  Gene Symbol: C16orf13
  Gene Name: chromosome 16 open reading frame 13
  ENSP ID: ENSP00000456393
AAAERNKDPILHVLRQYLDPAQRGVRVLEVASGSGQHAAHFARAFPLAEWQPSDVDQRCLDRGSSEQQDTCSNPGPCSSPTGEGVPFHSPNPSLQVCPRLSGKYPDLGPVGCVPMPTALCHQWEDLPPEQRGL

SEQ ID NO: 15963 - protein, 103 aa, Homo sapiens
  Payload ID: 3170
  Gene Symbol: C16orf13
  Gene Name: chromosome 16 open reading frame 13
  ENSP ID: ENSP00000456569
MLVAAAAERNKDPILHVLRQYLDPAQRGVRVLEVASGSGQHAAHFARAFPLAEWQPSDVDQRCLDRGSSEQQDTCSNPGPCSSPTGPMPSMGRSPPRATWTLT

SEQ ID NO: 15964 - protein, 184 aa, Homo sapiens
  Payload ID: 3170
  Gene Symbol: C16orf13
  Gene Name: chromosome 16 open reading frame 13
  ENSP ID: ENSP00000482089
MLVAAAAERNKDPILHVLRQYLDPAQRGVRVLEVASGSGQHAAHFARAFPLAEWQPSDVDQRCLDSIAATTQAQGLTNVKAPLHLDVTWGWEHWGGILPQSLDLLLCINMAHVSPLRCTEPYAINGKISPQSNVDFDLMLRCRNPEWGLRDTALLEDLGKASGLLLERMVDMPANNKCLIFRKN

SEQ ID NO: 15965 - protein, 204 aa, Homo sapiens
  Payload ID: 3171
  Gene Symbol: C16orf45
  Gene Name: chromosome 16 open reading frame 45
  Uniprot ID: Q96MC5
  ENSP ID: ENSP00000300006
MELKQSLSTHLEAEKPLRRYGAVEETAWKTERLGRNQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPASSRAEKKAEPPPSKPTVAKTGLALIKDCCGATQCNIM

SEQ ID NO: 15966 - protein, 187 aa, Homo sapiens
  Payload ID: 3171
  Gene Symbol: C16orf45
  Gene Name: chromosome 16 open reading frame 45
  Uniprot ID: Q96MC5
  ENSP ID: ENSP00000408976
MWGDLTETGCMGRRSAKKDQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPASSRAEKKAEPPPSKPTVAKTGLALIKDCCGATQCNIM

SEQ ID NO: 15967 - protein, 88 aa, Homo sapiens
  Payload ID: 3171
  Gene Symbol: C16orf45
  Gene Name: chromosome 16 open reading frame 45
  ENSP ID: ENSP00000455130
MELKQSLSTHLEAEKPLRRYGAVEETAWKTERLGRNQLDIISMAETTMMPEEIELEMAKIQRLREVLVRRESELRFMLCNLAQISYLL

SEQ ID NO: 15968 - protein, 115 aa, Homo sapiens
  Payload ID: 3171
  Gene Symbol: C16orf45
  Gene Name: chromosome 16 open reading frame 45
  ENSP ID: ENSP00000456084
  MOD_RES (1)..(1): Any amino acid
XMDDIQLCKDIMDLKQELQNLVAIPEKEKTKLQKQREDELIQKIHKLVQKRDFLVDDAEVERLREQEEDKEMADFLRIKLKPLDKVTKSPANEEVAVNPLPFSSGGCKRLQAEAE

SEQ ID NO: 15969 - protein, 175 aa, Homo sapiens
  Payload ID: 3171
  Gene Symbol: C16orf45
  Gene Name: chromosome 16 open reading frame 45
  ENSP ID: ENSP00000456219
  MOD_RES (1)..(1): Any amino acid
XQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPAICLRCVPGGGLDWHGSSVQKSQQGTGSSDVKARAVENGTQSRC

SEQ ID NO: 15970 - protein, 36 aa, Homo sapiens
  Payload ID: 3171
  Gene Symbol: C16orf45
  Gene Name: chromosome 16 open reading frame 45
  ENSP ID: ENSP00000457319
MELKQSLSTHLEAEKPLRRYGAVEETAWKTERLGRS

SEQ ID NO: 15971 - protein, 134 aa, Homo sapiens
  Payload ID: 3171
  Gene Symbol: C16orf45
  Gene Name: chromosome 16 open reading frame 45
  ENSP ID: ENSP00000457515
MPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPASLESLEKPEAYVSEY

SEQ ID NO: 15972 - protein, 151 aa, Homo sapiens
  Payload ID: 3171
  Gene Symbol: C16orf45
  Gene Name: chromosome 16 open reading frame 45
  ENSP ID: ENSP00000457867
MELKQSLSTHLEAEKPLRRYGAVEETAWKTERLGRNQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLRLPGREESRAPT

SEQ ID NO: 15973 - protein, 187 aa, Homo sapiens; identical to SEQ ID NO: 15966
  Payload ID: 3171
  Gene Symbol: C16orf45
  Gene Name: chromosome 16 open reading frame 45
  Uniprot ID: Q96MC5
  ENSP ID: ENSP00000477880

SEQ ID NO: 15974 - protein, 204 aa, Homo sapiens; identical to SEQ ID NO: 15965
  Payload ID: 3171
  Gene Symbol: C16orf45
  Gene Name: chromosome 16 open reading frame 45
  Uniprot ID: Q96MC5
  ENSP ID: ENSP00000483858

SEQ ID NO: 15975 - protein, 175 aa, Homo sapiens; identical to SEQ ID NO: 15969
  Payload ID: 3171
  Gene Symbol: C16orf45
  Gene Name: chromosome 16 open reading frame 45
  ENSP ID: ENSP00000487632
  MOD_RES (1)..(1): Any amino acid

SEQ ID NO: 15976 - protein, 88 aa, Homo sapiens; identical to SEQ ID NO: 15967
  Payload ID: 3171
  Gene Symbol: C16orf45
  Gene Name: chromosome 16 open reading frame 45
  ENSP ID: ENSP00000487963

SEQ ID NO: 15977 - protein, 115 aa, Homo sapiens; identical to SEQ ID NO: 15968
  Payload ID: 3171
  Gene Symbol: C16orf45
  Gene Name: chromosome 16 open reading frame 45
  ENSP ID: ENSP00000488214
  MOD_RES (1)..(1): Any amino acid

SEQ ID NO: 15978 - protein, 134 aa, Homo sapiens; identical to SEQ ID NO: 15971
  Payload ID: 3171
  Gene Symbol: C16orf45
  Gene Name: chromosome 16 open reading frame 45
  ENSP ID: ENSP00000488232

SEQ ID NO: 15979 - protein, 151 aa, Homo sapiens; identical to SEQ ID NO: 15972
  Payload ID: 3171
  Gene Symbol: C16orf45
  Gene Name: chromosome 16 open reading frame 45
  ENSP ID: ENSP00000488650

SEQ ID NO: 15980 - protein, 395 aa, Homo sapiens
  Payload ID: 3172
  Gene Symbol: C16orf46
  Gene Name: chromosome 16 open reading frame 46
  Uniprot ID: Q6P387
  ENSP ID: ENSP00000299578
MDLCQKNETDLENAENNEIQFTEETEPTYTCPDGKSEKNHVYCLLDVSDITLEQDEKAKEFIIGTGWEEAVQGWGRTSPAACIWPRKIPKKARVGEGACSDCLVCVNLSHWSLQTKPPTEGGPEKDQSSPSQTQAAPQGPSTASRAISDICFPTYFRAEKKSLQIKEFIWCNKDWAIPGTNRGKASGNPSGGAHRGLSIPGPLTSRALLVLPPLKASLSNALDVLGKKSKNSFLQSEEKVLDVEKDGCVAYAYGLKTADGKGEKRASELAKHPMVNDTPSSPSPAAQISLLTDPEQRCLHWSLLSEKNLACPPDPSNVRYLAALQLLQKRGVQSYKSKFKAKEPRSPVITRKHVLPKAKQENRPQMLETKVFPRPVLPSLTVSRVIIPVSTHRIL

SEQ ID NO: 15981 - protein, 388 aa, Homo sapiens
  Payload ID: 3172
  Gene Symbol: C16orf46
  Gene Name: chromosome 16 open reading frame 46
  Uniprot ID: Q6P387
  ENSP ID: ENSP00000367874
MDLCQKNETDLENAENNEIQFTEETEPTYTCPDGKSEKNHVYCLLDVSDITLEQDEKAKEFIIGTGWEEAVQGWGRTSPAACIWPRKIPKKARVGEGACSDCLVCVNLSHWSLQTKPPTEGGPEKDQSSPSQTQAAPQGPSTASRAISDICFPTYFRAEKKSLQIKEFIWCNKDWAIPGTNRGKASGNPSGGAHRGLSIPGPLTSRALLVLPPLKASLSNALDVLGKKSKNSFLQSEEKVLDVEKDGCVAYAYGLKTADGKGEKRASELAKHPMVNDTPSSPSPAAQISLLTDPEQRCLHWSLLSEKNLACPPDPSNVRYLAALQLLQKRGVQSYKSKFKAKEPRSPVITRKHVLPKAKQENRPQMLETKVFPRPVLPSLTHRKKKIK

SEQ ID NO: 15982 - protein, 67 aa, Homo sapiens
  Payload ID: 3172
  Gene Symbol: C16orf46
  Gene Name: chromosome 16 open reading frame 46
  ENSP ID: ENSP00000455877
MDLCQKNETDLENAENNEIQFTEETEPTYTCPDGKSEKNHVYCLLDVSDITLEQDEKAKEFIIGTGW

SEQ ID NO: 15983 - protein, 38 aa, Homo sapiens
  Payload ID: 3173
  Gene Symbol: C16orf52
  Gene Name: chromosome 16 open reading frame 52
  Uniprot ID: Q8NHV5
  ENSP ID: ENSP00000454543
MDKLTIISGCLFLAADIFAIASIANPDWINTGESAVSP

SEQ ID NO: 15984 - protein, 167 aa, Homo sapiens
  Payload ID: 3173
  Gene Symbol: C16orf52
  Gene Name: chromosome 16 open reading frame 52
  Uniprot ID: Q8NHV5
  ENSP ID: ENSP00000454926
MDKLTIISGCLFLAADIFAIASIANPDWINTGESAGALTVGLVRQCQTIHGRDRTCIPPRLPPEWVTTLFFIIMGIISLTVTCGLLVASHWRREATKYARWIAFTGMILFCMAALIFPIGFYINEVGGQPYKLPNNTVVGSSYVLFVLSIFFTIVGLLFAGKVCLPG

SEQ ID NO: 15985 - protein, 39 aa, Homo sapiens
  Payload ID: 3173
  Gene Symbol: C16orf52
  Gene Name: chromosome 16 open reading frame 52
  ENSP ID: ENSP00000455164
LTIISGCLFLAADIFAIASIANPDWINTGESAGSLCMLN

SEQ ID NO: 15986 - protein, 108 aa, Homo sapiens
  Payload ID: 3173
  Gene Symbol: C16orf52
  Gene Name: chromosome 16 open reading frame 52
  ENSP ID: ENSP00000455694
MDKLTIISGCLFLAADIFAIASIANPDWINTGESAGALTVGLVRQCQTIHGRDRTCIPPRLPPEWVTTLFFIIMGIISLTVTCGLLVASHWRREATKYARWIAFTGSK

SEQ ID NO: 15987 - protein, 114 aa, Homo sapiens
  Payload ID: 3173
  Gene Symbol: C16orf52
  Gene Name: chromosome 16 open reading frame 52
  ENSP ID: ENSP00000456262
MDKLTIISGCLFLAADIFAIASIANPDWINTGESAGALTVGLVRQCQTIHGRDRTCIPPRLPPEWVTTLFFIIMGIISLTVTCGLLVASHWRREATKYARWIAFTGKCVHSSHT

SEQ ID NO: 15988 - protein, 90 aa, Homo sapiens
  Payload ID: 3173
  Gene Symbol: C16orf52
  Gene Name: chromosome 16 open reading frame 52
  ENSP ID: ENSP00000456506
MGQSWELTAAERAMRIQGALTVGLVRQCQTIHGRDRTCIPPRLPPEWVTTLFFIIMGIISLTVTCGLLVASHWRREATKYARWIAFTGSK

SEQ ID NO: 15989 - protein, 224 aa, Homo sapiens
  Payload ID: 3174
  Gene Symbol: C16orf54
  Gene Name: chromosome 16 open reading frame 54
  Uniprot ID: Q6UWD8
  ENSP ID: ENSP00000327506
MPLTPEPPSGRVEGPPAWEAAPWPSLPCGPCIPIMLVLATLAALFILTTAVLAERLFRRALRPDPSHRAPTLVWRPGGELWIEPMGTARERSEDWYGSAVPLLTDRAPEPPTQVGTLEARATAPPAPSAPNSAPSNLGPQTVLEVPARSTFWGPQPWEGRPPATGLVSWAEPEQRPEASVQFGSPQARRQRPGSPDPEWGLQPRVTLEQISAFWKREGRTSVGF

SEQ ID NO: 15990 - protein, 468 aa, Homo sapiens
  Payload ID: 3175
  Gene Symbol: C16orf58
  Gene Name: chromosome 16 open reading frame 58
  Uniprot ID: Q96GQ5
  ENSP ID: ENSP00000317579
MADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQNQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 15991 - protein, 468 aa, Homo sapiens; identical to SEQ ID NO: 15990
  Payload ID: 3175
  Gene Symbol: C16orf58
  Gene Name: chromosome 16 open reading frame 58
  Uniprot ID: Q96GQ5
  ENSP ID: ENSP00000398074

SEQ ID NO: 15992 - protein, 423 aa, Homo sapiens
  Payload ID: 3175
  Gene Symbol: C16orf58
  Gene Name: chromosome 16 open reading frame 58
  ENSP ID: ENSP00000456050
MADDAGLETPLCSEQFGSGEARGCRAAADGSLQWEGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQNQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 15993 - protein, 140 aa, Homo sapiens
  Payload ID: 3175
  Gene Symbol: C16orf58
  Gene Name: chromosome 16 open reading frame 58
  ENSP ID: ENSP00000456602
MADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQIQLACWAASSLPGGKVHRECCWWGHSGCPDRAPGSEEQHG

SEQ ID NO: 15994 - protein, 466 aa, Homo sapiens
  Payload ID: 3175
  Gene Symbol: C16orf58
  Gene Name: chromosome 16 open reading frame 58
  ENSP ID: ENSP00000456775
MADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQNQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 15995 - protein, 135 aa, Homo sapiens
  Payload ID: 3175
  Gene Symbol: C16orf58
  Gene Name: chromosome 16 open reading frame 58
  ENSP ID: ENSP00000457087
MADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQIQLACWAASSLPGGKGANWTAMPSSGGFLRTSSMT

SEQ ID NO: 15996 - protein, 82 aa, Homo sapiens
  Payload ID: 3175
  Gene Symbol: C16orf58
  Gene Name: chromosome 16 open reading frame 58
  ENSP ID: ENSP00000459952
MLGRIVFAWWKGSKLDCNAKQWRLFADILNDVAMFLEIMAPVYPICFTMTVSTSNLAKCIVSVAGGATRAALTVHQARRNNM

SEQ ID NO: 15997 - protein, 433 aa, Homo sapiens
  Payload ID: 3176
  Gene Symbol: C16orf59
  Gene Name: chromosome 16 open reading frame 59
  Uniprot ID: Q7L2K0
  ENSP ID: ENSP00000355022
MLPAGCSRRLVAELQGALDACAQRQLQLEQSLRVCRRLLHAWEPTGTRALKPPPGPETNGEDPLPACTPSPQDLKELEFLTQALEKAVRVRRGITKAGERDKAPSLKSRSIVTSSGTTASAPPHSPGQAGGHASDTRPTKGLRQTTVPAKGHPERRLLSVGDGTRVGMGARTPRPGAGLRDQQMAPSAAPQAPEAFTLKEKGHLLRLPAAFRKAASQNSSLWAQLSSTQTSDSTDAAAAKTQFLQNMQTASGGPQPRLSAVEVEAEAGRLRKACSLLRLRMREELSAAPMDWMQEYRCLLTLEGLQAMVGQCLHRLQELRAAVAEQPPRPCPVGRPPGASPSCGGRAEPAWSPQLLVYSSTQELQTLAALKLRVAVLDQQIHLEKVLMAELLPLVSAAQPQGPPWLALCRAVHSLLCEGGARVLTILRDEPAV

SEQ ID NO: 15998 - protein, 405 aa, Homo sapiens
  Payload ID: 3176
  Gene Symbol: C16orf59
  Gene Name: chromosome 16 open reading frame 59
  ENSP ID: ENSP00000454787
MLPAGCSRRLVAELQGALDACAQRQLQLEQSLRVCRRLLHAWEPTGTRALKPPPGPETNGEDPLPACTPSPQDLKELEFLTQALEKAVRVRRGITKAGERDKAPSLKSRSIVTSSGTTASAPPHSPGQAGGHASDTRPTKGLRQTTVPAKGHPERRLLSVGDGTRVGMGARTPRPGAGLRDQQMAPSAAPQAPEAFTLKEKGHLLRLPAAFRKAASQNSSLWAQLSSTQTSDSTDAAAAKTQFLQNMQTASGGPQPRLSAVEVEAEAGRLRKACSLLRLRMREELSAAPMDWMQEYRCLLTLEGLQAMVGQCLHRLQELRAAVAEQPPRPCPVGRPPGASPSCGGRAEPAWSPQLLVYSSTQELQTLAALKLRVAVLDQQIHLEKVLLEEEVGVQQRSAALRTRG

SEQ ID NO: 15999 - protein, 99 aa, Homo sapiens
  Payload ID: 3176
  Gene Symbol: C16orf59
  Gene Name: chromosome 16 open reading frame 59
  ENSP ID: ENSP00000455315
MQTASGGPQPRLSAVEVEAEAGRLRKACSLLRLRMREELSAAPMDWMQEYRCLLTLEGLQAMVGQCLHRLQELRAAVAEQPPRPCPVGRPPGASPSCGG

SEQ ID NO: 16000 - protein, 266 aa, Homo sapiens
  Payload ID: 3176
  Gene Symbol: C16orf59
  Gene Name: chromosome 16 open reading frame 59
  Uniprot ID: Q7L2K0
  ENSP ID: ENSP00000456478
MGARTPRPGAGLRDQQMAPSAAPQAPEAFTLKEKGHLLRLPAAFRKAASQNSSLWAQLSSTQTSDSTDAAAAKTQFLQNMQTASGGPQPRLSAVEVEAEAGRLRKACSLLRLRMREELSAAPMDWMQEYRCLLTLEGLQAMVGQCLHRLQELRAAVAEQPPRPCPVGRPPGASPSCGGRAEPAWSPQLLVYSSTQELQTLAALKLRVAVLDQQIHLEKVLMAELLPLVSAAQPQGPPWLALCRAVHSLLCEGGARVLTILRDEPAV

SEQ ID NO: 16001 - protein, 285 aa, Homo sapiens
  Payload ID: 3176
  Gene Symbol: C16orf59
  Gene Name: chromosome 16 open reading frame 59
  ENSP ID: ENSP00000457153
MLPAGCSRREPTGTRALKPPPGPETNGEDPLPACTPSPQDLKELEFLTQALEKAVRVRRGITKAGERDKAPSLKSRSIVTSSGTTASAPPHSPGQAGGHASDTRPTKGLRQTTVPAKGHPERRLLSVGDGTRVGMGARTPRPGAGLRDQQMAPSAAPQAPEAFTLKEKGHLLRLPAAFRKAASQNSSLWAQLSSTQTSDSTDAAAAKTQFLQNMQTASGGPQPRLSAVEVEAEAGRLRKACSLLRLRMREELSAAPMDWMQEYRCLLTLEGLQAMVGQCLHRLQE

SEQ ID NO: 16002 - protein, 171 aa, Homo sapiens
  Payload ID: 3176
  Gene Symbol: C16orf59
  Gene Name: chromosome 16 open reading frame 59
  ENSP ID: ENSP00000457450
  MOD_RES (1)..(1): Any amino acid
XNLGPLSPLLARQPPPHRIPQAKLVAMLQTRDPPRASARPRCLPRATLSAGCCQWGMGPVLGWEPEPPGLGRASGTSKWPHPLLLRPQKPSHSRRRGTCCGCLRHSGKQLPRTRACGPSSVPHRPVIPRMPPLPKPSSSRTCRQLQAGPSPGSVLWRWRRRRGACGRPARC

SEQ ID NO: 16003 - protein, 405 aa, Homo sapiens; identical to SEQ ID NO: 15998
  Payload ID: 3176
  Gene Symbol: C16orf59
  Gene Name: chromosome 16 open reading frame 59
  ENSP ID: ENSP00000458565

SEQ ID NO: 16004 - protein, 1052 aa, Homo sapiens
  Payload ID: 3177
  Gene Symbol: C16orf62
  Gene Name: chromosome 16 open reading frame 62
  ENSP ID: ENSP00000251143
MAPAGVVTRAVRSGELPLTSMASAENEACAVRSVACPSQAWRLQKVLCGRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 16005 - protein, 963 aa, Homo sapiens
  Payload ID: 3177
  Gene Symbol: C16orf62
  Gene Name: chromosome 16 open reading frame 62
  Uniprot ID: Q7Z3J2
  ENSP ID: ENSP00000395973
MAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 16006 - protein, 813 aa, Homo sapiens [sequence omitted]

SEQ ID NO: 16007 - protein, 1052 aa, Homo sapiens; identical to SEQ ID NO: 16004
  Payload ID: 3177
  Gene Symbol: C16orf62
  Gene Name: chromosome 16 open reading frame 62
  ENSP ID: ENSP00000400815

SEQ ID NO: 16008 - protein, 40 aa, Homo sapiens
  Payload ID: 3177
  Gene Symbol: C16orf62
  Gene Name: chromosome 16 open reading frame 62
  ENSP ID: ENSP00000438557
MAVFPWHSRNRNYKAEFASCRLEAVPLEFGDYHPLKPITL

SEQ ID NO: 16009 - protein, 273 aa, Homo sapiens
  Payload ID: 3177
  Gene Symbol: C16orf62
  Gene Name: chromosome 16 open reading frame 62
  ENSP ID: ENSP00000438852
MAPAGVVTRAVRSGELPLTSMASAENEACAVRSVACPSQAWRLQKVLCGRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKDGGYSEPRSRHRTPAWTTEQSWDCHIGNVREGADPAGGAG

SEQ ID NO: 16010 - protein, 959 aa, Homo sapiens
  Payload ID: 3177
  Gene Symbol: C16orf62
  Gene Name: chromosome 16 open reading frame 62
  ENSP ID: ENSP00000442468
MAPAGVVTRAVRSGELPLTSMASAENEACAVRSVACPSQAWRLQKVLCGRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 16011 - protein, 168 aa, Homo sapiens
  Payload ID: 3177
  Gene Symbol: C16orf62
  Gene Name: chromosome 16 open reading frame 62
  ENSP ID: ENSP00000455045
MAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSIAKLGLPHWQCQRRCGPGWRSWMTLRRVPKRSC

SEQ ID NO: 16012 - protein, 95 aa, Homo sapiens
  Payload ID: 3177
  Gene Symbol: C16orf62
  Gene Name: chromosome 16 open reading frame 62
  ENSP ID: ENSP00000456425
MGLTPSPCLQPLLTPQPWQLPCSRRKRDRDDNSVVGSDFEPWTNKRGEILARYTTTEKLSINLFMGSEKGKAGTATLAMSEKVRTRLEELDDFEE

SEQ ID NO: 16013 - protein, 73 aa, Homo sapiens
  Payload ID: 3177
  Gene Symbol: C16orf62
  Gene Name: chromosome 16 open reading frame 62
  ENSP ID: ENSP00000457190
  MOD_RES (1)..(1): Any amino acid
XICLWDLKKGSQKELLNLTQQDYVNRIEELNQSLKDAWASDQKVKALKIVIQVSSSDPPPPPRISYVKFHCET

SEQ ID NO: 16014 - protein, 116 aa, Homo sapiens
  Payload ID: 3177
  Gene Symbol: C16orf62
  Gene Name: chromosome 16 open reading frame 62
  ENSP ID: ENSP00000457779
  MOD_RES (1)..(1): Any amino acid
XLAKDEALKRQSSLGLSFFNSILAHGDLRNNKLNQLSVNLWHLAQRHGCADTRTMGLDMLPGTVTAIFVLALMKPTLEMMERMLPWRAVEPGPNQAFLPRETELSGHRGLPGLGCL

SEQ ID NO: 16015 - protein, 712 aa, Homo sapiens
  Payload ID: 3177
  Gene Symbol: C16orf62
  Gene Name: chromosome 16 open reading frame 62
  ENSP ID: ENSP00000457973
MCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 16016 - protein, 451 aa, Homo sapiens
  Payload ID: 3177
  Gene Symbol: C16orf62
  Gene Name: chromosome 16 open reading frame 62
  ENSP ID: ENSP00000458116
MAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEVTARWLQCDAHLLYGDSPCPLCPLTLMGPFHNSYSNVSASQPL

SEQ ID NO: 16017 - protein, 95 aa, Homo sapiens
  Payload ID: 3177
  Gene Symbol: C16orf62
  Gene Name: chromosome 16 open reading frame 62
  ENSP ID: ENSP00000459108
MIRGIGDPLVSVYARAYLCRVGMEVAPHLKETLNKNFFDFLLTFKQIHGDTVQNQLVVQGVELPSYLPLYPPAMDWIFQCISYHAPEALLTEMME

SEQ ID NO: 16018 - protein, 422 aa, Homo sapiens
  Payload ID: 3178
  Gene Symbol: C16orf70
  Gene Name: chromosome 16 open reading frame 70
  Uniprot ID: Q9BSU1
  ENSP ID: ENSP00000219139
MLDLEVVPERSLGNEQWEFTLGMPLAQAVAILQKHCRIIKNVQVLYSEQSPLSHDLILNLTQDGIKLMFDAFNQRLKVIEVCDLTKVKLKYCGVHFNSQAIAPTIEQIDQSFGATHPGVYNSAEQLFHLNFRGLSFSFQLDSWTEAPKYEPNFAHGLASLQIPHGATVKRMYIYSGNSLQDTKAPMMPLSCFLGNVYAESVDVLRDGTGPAGLRLRLLAAGCGPGLLADAKMRVFERSVYFGDSCQDVLSMLGSPHKVFYKSEDKMKIHSPSPHKQVPSKCNDYFFNYFTLGVDILFDANTHKVKKFVLHTNYPGHYNFNIYHRCEFKIPLAIKKENADGQTETCTTYSKWDNIQELLGHPVEKPVVLHRSSSPNNTNPFGSTFCFGLQRMIFEVMQNNHIASVTLYGPPRPGSHLRTAELP

SEQ ID NO: 16019 - protein, 422 aa, Homo sapiens; identical to SEQ ID NO: 16018
  Payload ID: 3178
  Gene Symbol: C16orf70
  Gene Name: chromosome 16 open reading frame 70
  Uniprot ID: Q9BSU1
  ENSP ID: ENSP00000455182

SEQ ID NO: 16020 - protein, 165 aa, Homo sapiens
  Payload ID: 3178
  Gene Symbol: C16orf70
  Gene Name: chromosome 16 open reading frame 70
  ENSP ID: ENSP00000456154
MLDLEVVPERSLGNEQWEFTLGMPLAQAVAILQKHCRIIKNVQVLYSEQVIEVCDLTKVKLKYCGVHFNSQAIAPTIEQIDQSFGATHPGVYNSAEQLFHLNFRGLSFSFQLDSWTEAPKYEPNFAHGLASLQIPHGATVKRMYIYSGNSLQDTKAPMMPLSCFL

SEQ ID NO: 16021 - protein, 222 aa, Homo sapiens
  Payload ID: 3178
  Gene Symbol: C16orf70
  Gene Name: chromosome 16 open reading frame 70
  ENSP ID: ENSP00000456549
MLDLEVVPERSLGNEQWEFTLGMPLAQAVAILQKHCRIIKNVQVLYSEQVIEVCDLTKVKLKYCGVHFNSQAIAPTIEQIDQSFGATHPGVYNSAEQLFHLNFRGLSFSFQLDSWTEAPKYEPNFAHGLASLQIPHGATVKRMYIYSGNSLQDTKAPMMPLSCFLGNVYAESVDVLRDGTGPAGLRLRLLAAGCGPGLLADAKMRVFERSVYFGDSCQDVLS

SEQ ID NO: 16022 - protein, 320 aa, Homo sapiens
  Payload ID: 3178
  Gene Symbol: C16orf70
  Gene Name: chromosome 16 open reading frame 70
  ENSP ID: ENSP00000456688
MLDLEVVPERSLGNEQWEFTLGMPLAQAVAILQKHCRIIKNVQVLYSEQSPLSHDLILNLTQDGIKLMFDAFNQRLKVIEVCDLTKVKLKYCGVHFNSQAIAPTIEQIDQSFGATHPGVYNSAEQLFHLNFRGLSFSFQLDSWTEAPKYEPNFAHGLASLQIPHGATVKRMYIYSGNSLQDTKAPMMPLSCFLGNVYAESVDVLRDGTGPAGLRLRLLAAGCGPGLLADAKMRVFERSVYFGDSCQDVLSMLGSPHKVFYKSEDKMKIHSPSPHKQVPSKCNDYFFNYFTLGVDILFDANTHKVKKFVLHTNYPGHYNFN

SEQ ID NO: 16023 - protein, 98 aa, Homo sapiens
  Payload ID: 3178
  Gene Symbol: C16orf70
  Gene Name: chromosome 16 open reading frame 70
  ENSP ID: ENSP00000464242
  MOD_RES (1)..(1): Any amino acid
XSPNNTNPFGSTFCFGLQRMIFEVMQNNHIASVTLYGPPRYSSVHLWPAGASRGHRLQREAQSLSLDSWTQELSTNKEAGEVNPCPMHIGKTWGSFCD

SEQ ID NO: 16024 - protein, 520 aa, Homo sapiens
  Payload ID: 3179
  Gene Symbol: C16orf71
  Gene Name: chromosome 16 open reading frame 71
  Uniprot ID: Q8IYS4
  ENSP ID: ENSP00000299320
MASNDKGMAPSLGSPWASQMGPWDAILKAVKDQLPSLDSDSPLSDYGEEELFIFQRNQTSLIPDLSEELAEDPADGDKSRAWVAAAEESLPEPVLVPAELATEPGCRQNTRTKDASSQEGRDPGRPFESSGEVSALLGMAEEPPRWLEGDLGSLSFNTKGSQGPPWDPQAEATLSCHEGDPKAEPLSTASQESVNRRALRQERRKMIETDILQKVTRDACGPTSSDKGGVKEAPCHAAESAPRSKMPLVEPPEGPPVLSLQQLEAWDLDDILQSLAGQEDNQGNRAPGTVWWAADHRQVQDRMVPSAHNRLMEQLALLCTTQSKASACARKVPADTPQDTKEADSGSRCASRKQGSQAGPGPQLAQGMRLNAESPTIFIDLRQMELPDHLSPESSSHSSSDSEEEEEEEMAALGDAEGASPSSLGLRTCTGKSQLLQQLRAFQKGTAQPELPASKGPAGGRAQAPEDTAGSRTGRKQHMKLCAKGQSAQARLPRGRPRALGDVPEPGAAREALMPPLEQL

SEQ ID NO: 16025 - protein, 156 aa, Homo sapiens
  Payload ID: 3179
  Gene Symbol: C16orf71
  Gene Name: chromosome 16 open reading frame 71
  ENSP ID: ENSP00000467133
MASNDKGMAPSLGSPWASQMGPWDAILKAVKDQLPSLDSDSPLSDYGEEELFIFQRNQTSLIPDLSEELAEDPADGDKSRAWVAAAEESLPEPVLVPAELATEPGCRQNTRTKDASSQEGRDPGRPFESSGEVSALLGMAEEPPRWLEGDLGSLSF

SEQ ID NO: 16026 - protein, 537 aa, Homo sapiens
  Payload ID: 3179
  Gene Symbol: C16orf71
  Gene Name: chromosome 16 open reading frame 71
  ENSP ID: ENSP00000467565
MASNDKGMAPSLGSPWASQMGPWDAILKAVKDQLPSLDSDSPLSDYGEEELFIFQRNQTSLIPDLSEELAEDPADGDKSRAWVAAAEESLPEVCGTQKSIRLCVCDPVLVPAELATEPGCRQNTRTKDASSQEGRDPGRPFESSGEVSALLGMAEEPPRWLEGDLGSLSFNTKGSQGPPWDPQAEATLSCHEGDPKAEPLSTASQESVNRRALRQERRKMIETDILQKVTRDACGPTSSDKGGVKEAPCHAAESAPRSKMPLVEPPEGPPVLSLQQLEAWDLDDILQSLAGQEDNQGNRAPGTVWWAADHRQVQDRMVPSAHNRLMEQLALLCTTQSKASACARKVPADTPQDTKEADSGSRCASRKQGSQAGPGPQLAQGMRLNAESPTIFIDLRQMELPDHLSPERSGGSSHSSSDSEEEEEEEMAALGDAEGASPSSLGLRTCTGKSQLLQQLRAFQKGTAQPELPASKGPAGGRAQAPEDTAGSRTGRKQHMKLCAKGQSAQARLPRGRPRALGDVPEPGAAREALMPPLEQL

SEQ ID NO: 16027 - protein, 136 aa, Homo sapiens
  Payload ID: 3179
  Gene Symbol: C16orf71
  Gene Name: chromosome 16 open reading frame 71
  ENSP ID: ENSP00000477582
DILQKVTRDACGPTSSDKGGVKEAPCHAAESAPRSKMPLVEPPEGPPVLSLQQLEAWDLDDILQSLAGQEDNQGNRAPGTVWWAADHRQVQGLTLNTGAHVNPHKQHLPGPLRHRGLQAGHRQSCSPHKSSLLAPP

SEQ ID NO: 16028 - protein, 275 aa, Homo sapiens
  Payload ID: 3180
  Gene Symbol: C16orf72
  Gene Name: chromosome 16 open reading frame 72
  Uniprot ID: Q14CZ0
  ENSP ID: ENSP00000331720
MEERKEEGEAEIQEHGPEHWFSKWERQCLAEAEQDEQLPPELQEEAAAAAQPEHKQQKLWHLFQNSATAVAQLYKDRVCQQPGLSLWVPFQNAATAVTNLYKESVDTHQRSFDIGIQIGYQRRNKDVLAWVKKRRRTIRREDLISFLCGKVPPPRNSRAPPRLTVVSPNRATSTETSSSVETDLQPFREAIALHGLSGAMASISVRSSTPGSPTHVSSGSNASRRRNGLHDVDLNTFISEEMALHLDNGGTRKRTSAQCGDVITDSPTHKRNRMI

SEQ ID NO: 16029 - protein, 150 aa, Homo sapiens
  Payload ID: 3180
  Gene Symbol: C16orf72
  Gene Name: chromosome 16 open reading frame 72
  ENSP ID: ENSP00000484249
  MOD_RES (1)..(1): Any amino acid
XAQPEHKQQKLWHLFQNSATAVAQLYKDRVCQQPGLSLWVPFQNAATAVTNLYKESVDTHQRSFDIGIQIGYQRRNKDVLAWVKKRRRTIRREDLISFLCGKVPPPRNSRAPPRLTVVSPNRATSTETSSSVETDLQPFREAIALHGKAV

SEQ ID NO: 16030 - protein, 76 aa, Homo sapiens
  Payload ID: 3181
  Gene Symbol: C16orf74
  Gene Name: chromosome 16 open reading frame 74
  Uniprot ID: Q96GX8
  ENSP ID: ENSP00000284245
MGLKMSCLKGFQMCVSSSSSSHDEAPVLNDKHLDVPDIIITPPTPTGMMLPRDLGSTVWLDETGSCPDDGEIDPEA

SEQ ID NO: 16031 - protein, 29 aa, Homo sapiens
  Payload ID: 3181
  Gene Symbol: C16orf74
  Gene Name: chromosome 16 open reading frame 74
  ENSP ID: ENSP00000473306
MMLPRDLGSTVWLDETGSCPDDGEIDPEA

SEQ ID NO: 16032 - protein, 29 aa, Homo sapiens
  Payload ID: 3181
  Gene Symbol: C16orf74
  Gene Name: chromosome 16 open reading frame 74
  ENSP ID: ENSP00000473366
MMLPRDLGSTVWLDETGSCPDDGEIDPEA

SEQ ID NO: 16033 - protein, 76 aa, Homo sapiens
  Payload ID: 3181
  Gene Symbol: C16orf74
  Gene Name: chromosome 16 open reading frame 74
  ENSP ID: ENSP00000473398
MGLKMSCLKGFQMCVSSSSSSHDEAPVLNDKHLDVPDIIITPPTPTGMMLPRDLGSTGWTNQDANPRQLWNTNICQ

SEQ ID NO: 16034 - protein, 64 aa, Homo sapiens
  Payload ID: 3181
  Gene Symbol: C16orf74
  Gene Name: chromosome 16 open reading frame 74
  ENSP ID: ENSP00000473536
MCVSSSSSSHDEAPVLNDKHLDVPDIIITPPTPTGMMLPRDLGSTVWLDETGSCPDDGEIDPEA

SEQ ID NO: 16035 - protein, 28 aa, Homo sapiens
  Payload ID: 3181
  Gene Symbol: C16orf74
  Gene Name: chromosome 16 open reading frame 74
  ENSP ID: ENSP00000473676
MGLKMSCLKVWLDETGSCPDDGEIDPEA

SEQ ID NO: 16036 - protein, 265 aa, Homo sapiens
  Payload ID: 3182
  Gene Symbol: C16orf78
  Gene Name: chromosome 16 open reading frame 78
  Uniprot ID: Q8WTQ4
  ENSP ID: ENSP00000299191
MSEQQMDLKDLMPTKRKYMWKTAEDRRMSDLTCVLEWLERRQGKKKQAPEKQKPKVVTVLKRNKKKEEKKGKGLMTARGGNRRDTETSQQALGKRFRKDAASYRSLYGVEQKGKHLSMVPGSYIKDGPKKSDTDIKDAVDPESTQRPNPFRRQSIVLDPMLQEGTFNSQRATFIRDWSNKMPDMAYERKLKSLMEKSTEPKMETMRMLKPEEVLSCRYLRLSKENIRTLLKLCKDAGMNVDIHPHMVEEDIDAKKVFTGIPSMAL

SEQ ID NO: 16037 - protein, 317 aa, Homo sapiens
  Payload ID: 3183
  Gene Symbol: C16orf86
  Gene Name: chromosome 16 open reading frame 86
  Uniprot ID: Q6ZW13
  ENSP ID: ENSP00000384117
MASAGAERRPGVQEATVVGQGQLTEEPGSAQTSECPVAGDQFLVPAHEARGTQSEDQRPAGAASESELQEEGPKLGEERPKPHAGALEERGPRPVVSIVRPRHGPKRKPVKSLSLPGLRAHLKAEAELPPKLPLQEEEPEDSQSEPSPSAKQHKKAKKRKSLGAPVLHAVASMVSAPLETLRLERKAQRLRPLYQYVNYCNPELNQAGKGDGEAEVEAEAELAPVPEEGGVEQLQALLPLAGELGPGLALPCPSPLVTPTHALAPLGEEAGEEPGGLPSLGVSDHKAEVDKSTQVDIDKMLSVCTAPLVPPLSPQYK

SEQ ID NO: 16038 - protein, 56 aa, Homo sapiens
  Payload ID: 3183
  Gene Symbol: C16orf86
  Gene Name: chromosome 16 open reading frame 86
  ENSP ID: ENSP00000400874
MASAGAERRPGVQEATVVGQGQLTEEPGSAQTSEVFSDGSLCPLPGHGDRWPVCHL

SEQ ID NO: 16039 - protein, 198 aa, Homo sapiens
  Payload ID: 3183
  Gene Symbol: C16orf86
  Gene Name: chromosome 16 open reading frame 86
  ENSP ID: ENSP00000473620
MASAGAERRPGVQEATVVGQGQLTEEPGSAQTSECPVAGDQFLVPAHEARGTQSEDQRPAGAASESELQEEGPKLGEERPKPHAGALEERGPRPVVSIVRPRHGPKRKPVKSLSLPGLRAHLKAEAELPPKLPLQEEEPEDSQSEPSPSAKQHKKAKKRKSLGAPVLHAVASMVSAPLETLRLEPSALPWVFAGKAQR

SEQ ID NO: 16040 - protein, 170 aa, Homo sapiens
  Payload ID: 3183
  Gene Symbol: C16orf86
  Gene Name: chromosome 16 open reading frame 86
  ENSP ID: ENSP00000484244
GDQFLVPAHEARGTQSEDQRPAGAASESELQEEGPKLGEERPKPHAGALEERGPRPVVSIVRPRHGPKRKPVKSLSLPGLRAHLKAEAELPPKLPLQEEEPEDSQSEPSPSAKQHKKAKKRKSLGAPVLHAVASMVSAPLETLRLEREWQSLDCSFSPCLWGPTWHNLAL

SEQ ID NO: 16041 - protein, 154 aa, Homo sapiens
  Payload ID: 3184
  Gene Symbol: C16orf87
  Gene Name: chromosome 16 open reading frame 87
  Uniprot ID: Q6PH81
  ENSP ID: ENSP00000285697
MSATRAKKVKMATKSCPECDQQVPVACKSCPCGYIFISRKLLNAKHSEKSPPSTENKHEAKRRRTERVRREKINSTVNKDLENRKRSRSNSHSDHIRRGRGRPKSASAKKHEEEREKQEKEIDIYANLSDEKAFVFSVALAEINRKIINQRLIL

SEQ ID NO: 16042 - protein, 93 aa, Homo sapiens
  Payload ID: 3184
  Gene Symbol: C16orf87
  Gene Name: chromosome 16 open reading frame 87
  Uniprot ID: Q6PH81
  ENSP ID: ENSP00000378285
MSATRAKKVKMATKSCPECDQQVPVACKSCPCGYIFISRKLLNAKHSEKSPPSTEKQEKEIDIYANLSDEKAFVFSVALAEINRKIINQRLIL

SEQ ID NO: 16043 - protein, 161 aa, Homo sapiens
  Payload ID: 3184
  Gene Symbol: C16orf87
  Gene Name: chromosome 16 open reading frame 87
  ENSP ID: ENSP00000455829
  MOD_RES (1)..(1): Any amino acid
XGARAGGSGLAAVVCGGGPRRAPGGRAVPVACKSCPCGYIFISRKLLNAKHSEKSPPSTENKHEAKRRRTERVRREKINSTVNKDLENRKRSRSNSHSDHIRRGRGRPKSASAKKHEEERGCRKPMPRTPILEGKLGKEKSAEKKEKREILPGSENNILFS

SEQ ID NO: 16044 - protein, 402 aa, Homo sapiens
  Payload ID: 3185
  Gene Symbol: C16orf89
  Gene Name: chromosome 16 open reading frame 89
  Uniprot ID: Q6UX73
  ENSP ID: ENSP00000324672
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDSRSVAQAGVQWRNLGSLQPLPPGFKQFSCLILPSSWDYRSVPPYLANFYIFLVETGFHHVAHAGLELLISRDPPTSGSQSVGL

SEQ ID NO: 16045 - protein, 434 aa, Homo sapiens
  Payload ID: 3185
  Gene Symbol: C16orf89
  Gene Name: chromosome 16 open reading frame 89
  ENSP ID: ENSP00000417158
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENNVTGHPVFYLPLCDSFLPPKAAPVTELYTDGPVMFCGMGGFSDFYKLRWLEAILSWQKQQEGCFGEPDAEDEELSKAIQYQQHFSRRVKRREKQFPDSRSVAQAGVQWRNLGSLQPLPPGFKQFSCLILPSSWDYRSVPPYLANFYIFLVETGFHHVAHAGLELLISRDPPTSGSQSVGL

SEQ ID NO: 16046 - protein, 361 aa, Homo sapiens
  Payload ID: 3185
  Gene Symbol: C16orf89
  Gene Name: chromosome 16 open reading frame 89
  Uniprot ID: Q6UX73
  ENSP ID: ENSP00000420566
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDGCSSHNTATAVAALGGFLYILAEYPPANREPHPSTPPPPSSR

SEQ ID NO: 16047 - protein, 191 aa, Homo sapiens
  Payload ID: 3186
  Gene Symbol: C16orf90
  Gene Name: chromosome 16 open reading frame 90
  ENSP ID: ENSP00000382553
  MOD_RES (1)..(1): Any amino acid
XEQGPAAPKSWLLLPTTLALHGSLDAVSQAQGRPGHPDAPPNIYEGGLGSPQPQCPSAQGSKPKNFRLRHLRGLGLYLESHPPPTGQCESHWLGRLMAGGCLPQPEGTAWALDLPQGTLGPRNSLCSALLEARLPRDSLGSSASSSSMDPDKGALPQPSPSRLRPKRSWGTWEEAMCPLCKRTRSGALERP

SEQ ID NO: 16048 - protein, 182 aa, Homo sapiens
  Payload ID: 3186
  Gene Symbol: C16orf90
  Gene Name: chromosome 16 open reading frame 90
  Uniprot ID: A8MZG2
  ENSP ID: ENSP00000401335
MEALVCAFSELHIREDAVSQAQGRPGHPDAPPNIYEGGLGSPQPQCPSAQGSKPKNFRLRHLRGLGLYLESHPPPTGQCESHWLGRLMAGGCLPQPEGTAWALDLPQGTLGPRNSLCSALLEARLPRDSLGSSASSSSMDPDKGALPQPSPSRLRPKRSWGTWEEAMCPLCKRTRSGALERP

SEQ ID NO: 16049 - protein, 132 aa, Homo sapiens
  Payload ID: 3187
  Gene Symbol: C16orf91
  Gene Name: chromosome 16 open reading frame 91
  Uniprot ID: Q4G0I0
  ENSP ID: ENSP00000413100
MNRVLCAPAAGAVRALRLIGWASRSLHPLPGSRDRAHPAAEEEDDPDRPIEFSSSKANPHRWSVGHTMGKGHQRPWWKVLPLSCFLVALIIWCYLREESEADQWLRQVWGEVPEPSDRSEEPETPAAYRART

SEQ ID NO: 16050 - protein, 65 aa, Homo sapiens
  Payload ID: 3187
  Gene Symbol: C16orf91
  Gene Name: chromosome 16 open reading frame 91
  ENSP ID: ENSP00000455147
MGKGHQRPWWKVLPLSCFLVALIIWCYLREESEADQWLRQVWGEVPEPSDRSEEPETPAAYRART

SEQ ID NO: 16051 - protein, 132 aa, Homo sapiens
  Payload ID: 3188
  Gene Symbol: C16orf92
  Gene Name: chromosome 16 open reading frame 92
  Uniprot ID: Q96LL3
  ENSP ID: ENSP00000300575
MGAGVGVAGCTRGHRNWVPSQLPPREIKAGVSLAVVTEFAWVLAPRPKRATASALGTESPRFLDRPDFFDYPDSDQARLLAVAQFIGEKPIVFINSGSSPGLFHHILVGLLVVAFFFLLFQFCTHINFQKGA

SEQ ID NO: 16052 - protein, 114 aa, Homo sapiens
  Payload ID: 3188
  Gene Symbol: C16orf92
  Gene Name: chromosome 16 open reading frame 92
  ENSP ID: ENSP00000454560
APRPKRATASALGTESPRFLDRPDFFDYPDSDQARLLAVAQFIGEKPIVFINSGSSPGLFHHILVGLLVVAFFFLLFQFCTHIIVGGKEKTRRCPQTKRHRYSAKISPGQAAKR

SEQ ID NO: 16053 - protein, 39 aa, Homo sapiens
  Payload ID: 3188
  Gene Symbol: C16orf92
  Gene Name: chromosome 16 open reading frame 92
  ENSP ID: ENSP00000456798
MGAGVGVAGCTRGHRNCTQTQACHGVSPGDRVSALLRQT

SEQ ID NO: 16054 - protein, 49 aa, Homo sapiens
  Payload ID: 3188
  Gene Symbol: C16orf92
  Gene Name: chromosome 16 open reading frame 92
  ENSP ID: ENSP00000458048
SALGTESPRFLDRPDFFDYPDSDQARLLAVAQFIGEKPIVFINSGTAKR

SEQ ID NO: 16055 - protein, 158 aa, Homo sapiens
  Payload ID: 3189
  Gene Symbol: C16orf95
  Gene Name: chromosome 16 open reading frame 95
  Uniprot ID: Q9H693
  ENSP ID: ENSP00000253461
MRASRSPPSPRRCHHHHEATGAASGAAAGGPGAGCVGLCRLALTPSAQDGRNSTFQTYKKEVCLPRHSMHPGPWAICCECQTRFGGRLPVSRVEAALPYWVPLSLRPRKQHPCWMHAAGTTAGGSAVMSACCPSSSSSRPPTRTSYRLLQRVCCPSAS

SEQ ID NO: 16056 - protein, 239 aa, Homo sapiens
  Payload ID: 3189
  Gene Symbol: C16orf95
  Gene Name: chromosome 16 open reading frame 95
  ENSP ID: ENSP00000455079
MRASRSPPSPRRCHHHHEATGAASGAAAGGPGAGCVGLCRLALTPSAQDGRNSTFQTYKKEVCLPRHSMHPGPWAICCECQTRFGGRLPVSRVEAALPYWVPLSLRPRKQSQKTVQFPIPQTAKMCPCLCHRFGGRLPMPRDQAVMPYWVPQVLRSQQQIVRRQQSLKGIQAPLLDACCWHNCWRICGDECLLSKFQQLQAPYQDQLPAPAARLLPLGLLTLLQAIPRVIMAIRQCFGV

SEQ ID NO: 16057 - protein, 143 aa, Homo sapiens
  Payload ID: 3189
  Gene Symbol: C16orf95
  Gene Name: chromosome 16 open reading frame 95
  ENSP ID: ENSP00000484646
MRPLEQPQALLPGGRARGASGSAGWHSHPARRMAGKNSTFQTYKKEVCLPRHSMHPGPWAICCECQTRFGGRLPVSRVEAALPYWVPLSLRPRKQHPCWMHAAGTTAGGSAVMSACCPSSSSSRPPTRTSYRLLQRVCCPSAS

SEQ ID NO: 16058 - protein, 1141 aa, Homo sapiens
  Payload ID: 3190
  Gene Symbol: C16orf96
  Gene Name: chromosome 16 open reading frame 96
  Uniprot ID: A6NNT2
  ENSP ID: ENSP00000415027
MSFSLTFTELANIAIPQCGVLNFKALHLLLHGILEHIHMAELKKVLSGDEDFLQTSQVVIMPREGDAQPILNPMKRLSNVFDHVVSRLDKLENQLALLQDLPSTAQLLEASQGTARPVQDLWHLIKLRKMVEGHDEVMAKSMQTLQDLLTDLHALQVTITALRKEVDMLKNMLDKVHPERMDIFAEDFKIQNWKMVALQREVASLQNKFKTIPKTEDMVLWSGLHDAMFTSEIGSSPLDLWQSVEQLPEAALAQTTKYLEATRAIQVSEPVQNPQLLQTVWHYEVPELLPEGSSAQAVSLSRAQEPAQPPALTPESAPGCTTEFAPGPAPGTEPVPGLELGLELEPVPALGPVPGPSVTPGSLPAPWPVLGPVPAPGAQPPPLGDWPALPRRWPLPQGWPRVGSWPLWDLGVLRPTQPQPSRAPPPATEFGSLWPRPLQPYQSRQGEALQLAAVQVKGEENDVPSLRGLRERARKDGAPKDRTRKDGVPKDRGGKDVDPKDRAHKDDVPKDRGGKDVDPKDRAHKDDVPKDRGGKDGDPKDRVGKDGAPKEAQPKAPQSALHRLKTTAAIAAAAAAAYAAATSSAAQAAKVAAKFVKDAPATKMAAIATDTAAAGPLGVFADVLGAGPSRGATESQILGDDSEIYEILSPSYSAASIGPDPALSQAMVATKQAMSPEDKKRAVKYSMSHIAQIPVKHDSLKEEFAQLSCNLNQRLSYLANMGGPSSLGTTVDILQKKIGSLQKSRLKEEELERIWGNQIEMMKDRYITLDKAVENLQIRMDEFKTLQAQIKRLEMNKVNKSTMEEELREKADRSALAGKASRVDLETVALELNEMIQGILFKVTIHEDSWKKAMEELSKDVNTKLVHSDLDPLKKEMEEVWKIVRKLLIEGLRLDPDSAAGFRRKLFKRVKCISCDRPVEMMTGPQLITIRKAHLLSRLRPASANSCEYLQRQQMREQQWLQLQDLGIQEDCQQDWGDGPQNATSLKCKSCNLLTLYPYGDPHVIDYDSAEVDILGVDGILYKGRVNSQRGAQPLAVAKELAAVKAPSPPSQSLYDRVHSSALFGAICPPLCPRSSACSAASGPHLTMPARPPSLPPLLLLPPLIPSLRDPQQAPGSTRLSRAPHIESRVGRKPPEEPANP

SEQ ID NO: 16059 - protein, 118 aa, Homo sapiens
  Payload ID: 3191
  Gene Symbol: C17orf100
  Gene Name: chromosome 17 open reading frame 100
  ENSP ID: ENSP00000485561
MASARGAKQSSPRVGTTRYTETSTVRVETSSHRVETSSRRVETSQRRSEGPSLSPSGKRLPRILEASSRHVESSSQRTETTSRHVRASSLRVETSLHCAESPTPRAKPAARQNEKTAR

SEQ ID NO: 16060 - protein, 952 aa, Homo sapiens
  Payload ID: 3192
  Gene Symbol: C17orf104
  Gene Name: chromosome 17 open reading frame 104
  Uniprot ID: A2RUB1
  ENSP ID: ENSP00000386452
MEVRRGDTCPRPHPSGLREEGLEPKVAFPGGANRCWNLGADAGSRLTDVFGSVMLTGSASFYDCYTSQSEDNVDLRQTYTPFSSTEYSSSVDSSLFCAPWSTYGDDIKQPSNSQISIKNRIQTERNDYGSETDLYGLVSNILEEQDKSQPYFAEGTCSSNLKSVWPMNTSRFADHHDLLTETKRPIDTVISQQAFYSDESVSAMEKQYLRNSNLTPQQKIDELHHGFTGLDLEEQWMYPSRSDHSNCHNIQTNDTAKTTFQEYPLIKNCFTPQTGLSDIMKESGVDIYHYGRDRICTKGLEAPLQQKRAEMFLSQFNRYNENVDYCRYPEYVHPNKAKLNKCSNFSVQDSKKLANGTPETPTVEADTYTKLFQVKPANQKKMEETIPDQQNFTFPKTTPHLTEKQFAKEAVFTADFGLTSEYGLKPHTACPANDFANVTEKQQFAKPDPPHSEYFKSVNLLSNSATSSGGINLNRPTWMNVQTKNNTPIPYRNQGNLMKLNSHLSAASKGSNHSSDFPQLSSTNLTPNSNLFQKYCQENPSAFSSFDFSYSGAERIQSVNHIEGLTKPGEENLFKLVTDKKIKQPNGFCDNYSAQKYGIIENVNKHNFQAKPQSGHYDPEEGPKHLDGLSQNTYQDLLESQGHSNSHRTRGGDNSRVNRTQVSCFSNNYMMGDLRHNQCFQQLGSNGFPLRSTHPFGHSVVPLLDSYDLLSYDDLSHLYPYFNMMYGDNSFSGLMPTFGFQRPIKTRSGPASELHIRLEECCEQWRALEKERKKTELALAKNYPGKKVSSTNNTPVPRLTSNPSRVDRLIVDELRELARVVTLLGKMERLRSSLLHASISTALDRHLESIHIVQSRRKDEIVNASNRQRQGVPRCQDDRDVFALASAIKEMCVATRKTRTALWCALQMTLPKTASTADVVKPLQDTVNCEDKVHESINSSNPMNQRGETNKH

SEQ ID NO: 16061 - protein, 659 aa, Homo sapiens
  Payload ID: 3192
  Gene Symbol: C17orf104
  Gene Name: chromosome 17 open reading frame 104
  Uniprot ID: A2RUB1
  ENSP ID: ENSP00000386586
MNTSRFADHHDLLTETKRPIDTVISQQAFYSDESVSAMEKQYLRNSNLTPQQKIDELHHGFTGLDLEEQWMYPSRSDHSNCHNIQTNDTAKTTFQEYPLIKNCFTPQTGLSDIMKESGVDIYHYGRDRICTKGLEAPLQQKRAEMFLSQFNRYNENVDYCRYPEYVHPNKAKLNKCSNFSVQDSKKLANGTPETPTVEADTYTKLFQVKPANQKKMEETIPDQQNFTFPKTTPHLTEKQFAKEAVFTADFGLTSEYGLKPHTACPANDFANVTEKQQFAKPDPPHSEYFKSVNLLSNSATSSGGINLNRPTWMNVQTKNNTPIPYRNQGNLMKLNSHLSAASKGSNHSSDFPQLSSTNLTPNSNLFQKYCQENPSAFSSFDFSYSGAERIQSVNHIEGLTKPGEENLFKLVTDKKIKQPNGFCDNYSAQKYGIIENVNKHNFQAKPQSGHYDPEEGPKHLDGLSQNTYQDLLESQGHSNSHRTRGGDNSRVNRTQVSCFSNNYMMGDLRHNQCFQQLGSNGFPLRSTHPFGHSVVPLLDSYDLLSYDDLSHLYPYFNMMYGDNSFSGLMPTFGFQRPIKTRSGPASELHIRLEECCEQWRALEKERKKTELALAKNYPGKKVSSTNNTPVPRLTSNPSRVDRLIVDELRELARVSCKNR

SEQ ID NO: 16062 - protein, 129 aa, Homo sapiens
  Payload ID: 3192
  Gene Symbol: C17orf104
  Gene Name: chromosome 17 open reading frame 104
  ENSP ID: ENSP00000397957
MNTSRFADHHDLLTETKRPIDTVISQQAFYSDESVSAMEKQYLRNSNLTPQQKIDELHHGFTGLDLEEQWMYPSRSDHSNCHNIQTNDTAKTTFQEYPLIKNCFTPQTGLSDIMKESGVDIYHYGRDRI

SEQ ID NO: 16063 - protein, 163 aa, Homo sapiens
  Payload ID: 3192
  Gene Symbol: C17orf104
  Gene Name: chromosome 17 open reading frame 104
  ENSP ID: ENSP00000399809
MNTSRFADHHDLLTETKRPIDTVISQQAFYSDESVSAMEKQYLRNSNLTPQQKIDELHHGFTGLDLEEQWMYPSRSDHSNCHNIQTNDTAKTTFQEYPLIKNCFTPQTGLSDIMKESGVDIYHYGRDRICTKGLEAPLQQKRAEMFLSQFNRYNENVDYCRYP

SEQ ID NO: 16064 - protein, 71 aa, Homo sapiens
  Payload ID: 3192
  Gene Symbol: C17orf104
  Gene Name: chromosome 17 open reading frame 104
  ENSP ID: ENSP00000404941
MEPKVAFPGGANRCWNLGADAGSRLTDVFGSVMLTGSASFYDCYTSQSEDNVDLRQTYTPFSSTEYSSSVD

SEQ ID NO: 16065 - protein, 150 aa, Homo sapiens
  Payload ID: 3192
  Gene Symbol: C17orf104
  Gene Name: chromosome 17 open reading frame 104
  ENSP ID: ENSP00000467305
ERKKTELALAKNYPGKKVSSTNNTPVPRLTSNPSRVDRLIVDELRELARVVTLLGKMERLRSSLLHASISTALDRHLESIHIVQSRRKDEIVNASNRQRQGVPRCQDDRDVFALASAIKEMCVATRKTRTALWCALQMTLPKTASTADVH

SEQ ID NO: 16066 - protein, 164 aa, Homo sapiens
  Payload ID: 3193
  Gene Symbol: C17orf105
  Gene Name: chromosome 17 open reading frame 105
  Uniprot ID: B2RV13
  ENSP ID: ENSP00000415662
MNNSLDYLAYPVIVSNHRQSTTFRKKLDFGHYVSHKNRIQIAKPTVDTKPPVAHTNHILKLSKLQGEQKKINKIEYENKQLCQKIANAHRGPAKVDCWNEYFSKSLNRETRNRELVRITMENQGILKRLVDRKPHYDRRASEIDWQNSRRYIRNTTRYLLSQNE

SEQ ID NO: 16067 - protein, 58 aa, Homo sapiens
  Payload ID: 3193
  Gene Symbol: C17orf105
  Gene Name: chromosome 17 open reading frame 105
  ENSP ID: ENSP00000468141
  MOD_RES (1)..(1): Any amino acid
XRETRNRELVRITMENQGILKRLVDRKPHYDRRASEIDWQNSRRYIRNTTRYLLSQNE

SEQ ID NO: 16068 - protein, 190 aa, Homo sapiens
  Payload ID: 3194
  Gene Symbol: C17orf107
  Gene Name: chromosome 17 open reading frame 107
  Uniprot ID: Q6ZR85
  ENSP ID: ENSP00000370770
MKGTPSSLDTLMWIYHFHSSTEVALQPPLLSSLELSVAAAHEYLEQRFRELKSLEPPEPKMQGMLPAPKPTLGLVLREATASLVSFGTTLLEISALWLQQEARRLDGSAGPAPDGRDPGAALSRVAQAAGQGVRQAGAAVGASARLLVQGAWLCLCGRGLQGSASFLRQSQQQLGLGIPGEPVSSGHGVS

SEQ ID NO: 16069 - protein, 98 aa, Homo sapiens
  Payload ID: 3194
  Gene Symbol: C17orf107
  Gene Name: chromosome 17 open reading frame 107
  ENSP ID: ENSP00000429241
MKGTPSSLDTLMWIYHFHSSTEVALQPPLLSSLELSVAAAHEYLEQRFRELKSLEPPEPKMQGMLPAPKPTLGLVLREATASLVSFGTTLLEVGYWGA

SEQ ID NO: 16070 - protein, 570 aa, Homo sapiens
  Payload ID: 3195
  Gene Symbol: C17orf47
  Gene Name: chromosome 17 open reading frame 47
  Uniprot ID: Q8NEP4
  ENSP ID: ENSP00000354874
MVKTNKPGAKVAVSAQRGSEVTTNTSPQQGHGYVLASSHRSAAVSLNPSHRRSEAAHPTTPHSASDYPRSVSLQSGPGHYAVPTPRGPETGPRTESSRHSSPHLKSQKTQTLASHASSRQWKVSPPREEAARRGSESKSGREVGHHASSIPDAKSTHQLSFQDQKNNLQSQILEDDPPSKVQNPQGVRVPRRILSYPKDEAVQTEPIQRITTTSEIRSPRSPSLLEHGSSCVSADYQTAQRRVPVEESETGPYGPIPSKPKALYRNMNLDSLLKLSVLKDSDGVHRVSARVDPESLHKYSAYPETKPSAKVLVSSQVESNVRTPIRGNSEVGRRVTISPGVQSVEPTHHVTVPSVSEGSHKSSMFVTPEPIYKQQTQKPPEITYMSQGPTPRYPELSQKPSIHAELELTPRPLPPRSLPRYGPDSSWWPLLNPEVETPQSQLTTPDFEPKCSPSLDLLLSGFKIDSSPFCEDLKFQREKASLSPPSPPKEFPSWAPLSEVPQTPKHTCKQPIQRFTAFFLDVSEEMYNRVIWWLKGLCFSLLWAHCGSLGDGRTGEEWHLCIYRAGSFRR

SEQ ID NO: 16071 - protein, 172 aa, Homo sapiens
  Payload ID: 3196
  Gene Symbol: C17orf49
  Gene Name: chromosome 17 open reading frame 49
  Uniprot ID: Q8IXM2
  ENSP ID: ENSP00000411851
MTSASTKVGEIFSAAGAAFTKLGELTMQLHPVADSSPAGAKWTETEIEMLRAAVKRFGDDLNHISCVIKERTVAQIKATVKRKVYEDSGIPLPAESPKKGPKKVASGVLSPPPAAPPPSSSSVPEAGGPPIKKQKADVTLSALNDSDANSDVVDIEGLGETPPAKKLNFDQA

SEQ ID NO: 16072 - protein, 166 aa, Homo sapiens
  Payload ID: 3196
  Gene Symbol: C17orf49
  Gene Name: chromosome 17 open reading frame 49
  ENSP ID: ENSP00000447063
MQLHPVADSSPAGAKWTETEIEMLRAAVKRFGDDLNHISCVIKERTVAQIKATVKRKVYEDSGIPLPAESPKKGPKKVASGVLSPPPAAPPPSSSSVPEAGGPPIKKQKADVTLSALNDSDANSDVVDIEGLGETPPAKKLNFDQDSLTLDSGLLMTSADPPLLSC

SEQ ID NO: 16073 - protein, 157 aa, Homo sapiens
  Payload ID: 3196
  Gene Symbol: C17orf49
  Gene Name: chromosome 17 open reading frame 49
  ENSP ID: ENSP00000447646
MTSASTKVGEIFSAAGAAFTKLGELTMQLHPVADSSPAGAKWTETEIEMLRAAVKRFGDDLNHISCVIKERTVAQIKATVKRKVYEDSGIPLPAESPKKGPKKVASGVLSPPPAAPPPSSSSVPEAGGPPIKKQKADSLTLDSGLLMTSADPPLLSC

SEQ ID NO: 16074 - protein, 192 aa, Homo sapiens
  Payload ID: 3196
  Gene Symbol: C17orf49
  Gene Name: chromosome 17 open reading frame 49
  Uniprot ID: Q8IXM2
  ENSP ID: ENSP00000448598
MTSASTKVGEIFSAAGAAFTKLGELTMQLHPVADSSPAGAKWTETEIEMLRAAVKRFGDDLNHISCVIKERTVAQIKATVKRKVYEDSGIPLPAESPKKGPKKVASGVLSPPPAAPPPSSSSVPEAGGPPIKKQKADVTLSALNDSDANSDVVDIEGLGETPPAKKLNFDQDSLTLDSGLLMTSADPPLLSC

SEQ ID NO: 16075 - protein, 138 aa, Homo sapiens
  Payload ID: 3196
  Gene Symbol: C17orf49
  Gene Name: chromosome 17 open reading frame 49
  Uniprot ID: Q8IXM2
  ENSP ID: ENSP00000448746
MTSASTKVGEIFSAAGAAFTKLGELTMQLHPVADSSPAGAQIKATVKRKVYEDSGIPLPAESPKKGPKKVASGVLSPPPAAPPPSSSSVPEAGGPPIKKQKADVTLSALNDSDANSDVVDIEGLGETPPAKKLNFDQA

SEQ ID NO: 16076 - protein, 23 aa, Homo sapiens
  Payload ID: 3196
  Gene Symbol: C17orf49
  Gene Name: chromosome 17 open reading frame 49
  ENSP ID: ENSP00000468587
  MOD_RES (1)..(1): Any amino acid
XHISCVIKERTVAQIKATVKRKM

SEQ ID NO: 16077 - protein, 173 aa, Homo sapiens
  Payload ID: 3197
  Gene Symbol: C17orf50
  Gene Name: chromosome 17 open reading frame 50
  ENSP ID: ENSP00000474048
MQDCPDLLPARRCEDPLVEEGNGRAPGRGRGARGREGGVGGRGRGQPEAAGGQRDGGRGAAAGSGGGRRPRAALSVLLPAAPGVQHPAGGAAAARGQRLLGLARPLSAAGRPNSSHRQEAEPPGGAVRAGDPATTAAPRGLCLLRAPLLQEMQESAQPPSLCGALRSGSPGSG

SEQ ID NO: 16078 - protein, 136 aa, Homo sapiens
  Payload ID: 3197
  Gene Symbol: C17orf50
  Gene Name: chromosome 17 open reading frame 50
  ENSP ID: ENSP00000474618
MDKHGVKTPLWKKETEELRAEDAEQEEGKEGSEDEDEDNQRPLEDSATEGEEPPRVAEEGEGRERRSVSYCPLRQESSTQQEAEPPGGAVRAGDPATTAAPRGLCLLRAPLLQEMQESAQPPSLCGALRSGSPGSG

SEQ ID NO: 16079 - protein, 174 aa, Homo sapiens
  Payload ID: 3197
  Gene Symbol: C17orf50
  Gene Name: chromosome 17 open reading frame 50
  Uniprot ID: Q8WW18
  ENSP ID: ENSP00000475146
MDKHGVKTPLWKKETEELRAEDAEQEEGKEGSEDEDEDNQRPLEDSATEGEEPPRVAEEGEGRERRSVSYCPLRQESSTQQVALLRRADSGFWGWLGPLALLGGLTAPTDRKRSLPEEPCVLEIRRRPPRRGGCACCELLFCKKCRSLHSHPAYVAHCVLDHPDLGKAGAAGNS

SEQ ID NO: 16080 - protein, 221 aa, Homo sapiens
  Payload ID: 3198
  Gene Symbol: C17orf51
  Gene Name: chromosome 17 open reading frame 51
  Uniprot ID: A8MQB3
  ENSP ID: ENSP00000384286
MGEKSRRKGPAPRHADGKLGRTCDHPYAPWSFTPSSRAPTAWVRPPCPVWASRLQEHSPEPRRARAPPTRRAQAALYAPALRLRDHLDRFSILMTSCTSWLQAPQAPGLCRDEQSSRISVPQLSGAPILLPDLEGTKLSNFQESSPLPHKHERKDKRSTPEEEGRSAPEKIIQSLKLCPGGHRPASLSSGCPAGCRLSFNLPPSMLLSVQKCCMPSSLKTC

SEQ ID NO: 16081 - protein, 182 aa, Homo sapiens
  Payload ID: 3198
  Gene Symbol: C17orf51
  Gene Name: chromosome 17 open reading frame 51
  ENSP ID: ENSP00000445158
MGEKSRRKGPAPRHADGKLGRTCDHPYAPWSFTPSSRAPTAWVRPPCPVWASRLQEHSPEPRRARAPPTRRAQAALYAPALRLRDHLDRFSILMTSCTSWLQAPQAPGLCRDEQSSRISVPQLSGAPILLPDLEGTKLSNFQEMGSHSIVQAGLELLASNNPPASASPSAGITGIISPAPQT

SEQ ID NO: 16082 - protein, 521 aa, Homo sapiens
  Payload ID: 3199
  Gene Symbol: C17orf53
  Gene Name: chromosome 17 open reading frame 53
  Uniprot ID: Q8N3J3
  ENSP ID: ENSP00000245382
MACSLQKLFAVEEEFEDEDFLSAVEDAENRFTGSLPVNAGRLRPVSSRPQETVQAQSSRLLLLHPTAPSEALGLPDLDLCLPASSTPSADSRPSCIGAAPLRPVSTSSSWIGNQRRVTVTEVLRETARPQSSALHPLLTFESQQQQVGGFEGPEQDEFDKVLASMELEEPGMELECGVSSEAIPILPAQQREGSVLAKKARVVDLSGSCQKGPVPAIHKAGIMSAQDESLDPVIQCRTPRPPLRPGAVGHLPVPTALTVPTQQLHWEVCPQRSPVQALQPLQAARGTIQSSPQNRFPCQPFQSPSSWLSGKAHLPRPRTPNSSCSTPSRTSSGLFPRIPLQPQAPVSSIGSPVGTPKGPQGALQTPIVTNHLVQLVTAASRTPQQPTHPSTRAKTRRFPGPAGILPHQAALKQLPRNKVPNMAVMIKSLTRSTMDASVVFKDPTGEMQGTVHRLLLETCQNELKPGSVLLLKQIGVFSPSLRNHYLNVTPNNLVHIYSPDSGDGSFLKPSQPFPKMTWMDS

SEQ ID NO: 16083 - protein, 647 aa, Homo sapiens
  Payload ID: 3199
  Gene Symbol: C17orf53
  Gene Name: chromosome 17 open reading frame 53
  Uniprot ID: Q8N3J3
  ENSP ID: ENSP00000313500
MACSLQKLFAVEEEFEDEDFLSAVEDAENRFTGSLPVNAGRLRPVSSRPQETVQAQSSRLLLLHPTAPSEALGLPDLDLCLPASSTPSADSRPSCIGAAPLRPVSTSSSWIGNQRRVTVTEVLRETARPQSSALHPLLTFESQQQQVGGFEGPEQDEFDKVLASMELEEPGMELECGVSSEAIPILPAQQREGSVLAKKARVVDLSGSCQKGPVPAIHKAGIMSAQDESLDPVIQCRTPRPPLRPGAVGHLPVPTALTVPTQQLHWEVCPQRSPVQALQPLQAARGTIQSSPQNRFPCQPFQSPSSWLSGKAHLPRPRTPNSSCSTPSRTSSGLFPRIPLQPQAPVSSIGSPVGTPKGPQGALQTPIVTNHLVQLVTAASRTPQQPTHPSTRAKTRRFPGPAGILPHQQSGRSLEDIMVSAPQTPTHGALAKFQTEIVASSQASVEEDFGRGPWLTMKSTLGLDERDPSCFLCTYSIVMVLRKQAALKQLPRNKVPNMAVMIKSLTRSTMDASVVFKDPTGEMQGTVHRLLLETCQNELKPGSVLLLKQIGVFSPSLRNHYLNVTPNNLVHIYSPDSGDGSFLKPSQPFPKDSGSFQHDVAAKPEEGFRTAQNLEAEASPEEELPEADDLDGLLSELPEDFFCGTSS

SEQ ID NO: 16084 - protein, 646 aa, Homo sapiens
  Payload ID: 3199
  Gene Symbol: C17orf53
  Gene Name: chromosome 17 open reading frame 53
  Uniprot ID: Q8N3J3
  ENSP ID: ENSP00000466618
MACSLQKLFAVEEEFEDEDFLSAVEDAENRFTGSLPVNAGRLRPVSSRPQETVQAQSSRLLLLHPTAPSEALGLPDLDLCLPASSTPSADSRPSCIGAAPLRPVSTSSSWIGNQRRVTVTEVLRETARPQSSALHPLLTFESQQQQVGGFEGPEQDEFDKVLASMELEEPGMELECGVSSEAIPILPAQQREGSVLAKKARVVDLSGSCQKGPVPAIHKAGIMSAQDESLDPVIQCRTPRPPLRPGAVGHLPVPTALTVPTQQLHWEVCPQRSPVQALQPLQAARGTIQSSPQNRFPCQPFQSPSSWLSGKAHLPRPRTPNSSCSTPSRTSSGLFPRIPLQPQAPVSSIGSPVGTPKGPQGALQTPIVTNHLVQLVTAASRTPQQPTHPSTRAKTRRFPGPAGILPHQQSGRSLEDIMVSAPQTPTHGALAKFQTEIVASSQASVEEDFGRGPWLTMKSTLGLDERDPSCFLCTYSIVMVLRKAALKQLPRNKVPNMAVMIKSLTRSTMDASVVFKDPTGEMQGTVHRLLLETCQNELKPGSVLLLKQIGVFSPSLRNHYLNVTPNNLVHIYSPDSGDGSFLKPSQPFPKDSGSFQHDVAAKPEEGFRTAQNLEAEASPEEELPEADDLDGLLSELPEDFFCGTSS

SEQ ID NO: 16085 - protein, 75 aa, Homo sapiens
  Payload ID: 3200
  Gene Symbol: C17orf58
  Gene Name: chromosome 17 open reading frame 58
  Uniprot ID: Q2M2W7
  ENSP ID: ENSP00000334741
MNRLYLTPDGFFFRVHMLALDSSSCNKPCPEFKPGIETDLNDAAYVLYTTVCNVGATARAVGRPAFFWERWETMT

SEQ ID NO: 16086 - protein, 97 aa, Homo sapiens
  Payload ID: 3200
  Gene Symbol: C17orf58
  Gene Name: chromosome 17 open reading frame 58
  Uniprot ID: Q2M2W7
  ENSP ID: ENSP00000402020
MNRLYLTPDGFFFRVHMLALDSSSCNKPCPEFKPGSRYIVMGHIYHKRRQLPTALLQVLRGRLRPGDGLLRSSSSYVKRFNRKREGQIQGAIHTQCI

SEQ ID NO: 16087 - protein, 75 aa, Homo sapiens; identical to SEQ ID NO: 16085
  Payload ID: 3200
  Gene Symbol: C17orf58
  Gene Name: chromosome 17 open reading frame 58
  Uniprot ID: Q2M2W7
  ENSP ID: ENSP00000443680

SEQ ID NO: 16088 - protein, 187 aa, Homo sapiens
  Payload ID: 3201
  Gene Symbol: C17orf62
  Gene Name: chromosome 17 open reading frame 62
  Uniprot ID: Q9BQA9
  ENSP ID: ENSP00000307765
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRSDVEAIAKLITSFLELHCLESPTELSQSSDSEAGDPASQS

SEQ ID NO: 16089 - protein, 227 aa, Homo sapiens
  Payload ID: 3201
  Gene Symbol: C17orf62
  Gene Name: chromosome 17 open reading frame 62
  ENSP ID: ENSP00000337560
MGHRSDVEAIASSSPASWSCTALRAPQSCLRAATVRPVTLQARADSPTVPEPVHRPQDPWHIPGVPEPVHRPQDPWHIPGVPEPVHRPQDPWHIPGVPEPVHRPQDPWHIPGVPEPVHRPQDPWPWLQLVPPAELAYCLLMLLLAHCMKQQARPGHPDFLHREAWACLSAAGVSPALDSCFGPQQDLGRVERRARPALVGADAACCPRHSVLSLVDIPSGQVLPQGQ

SEQ ID NO: 16090 - protein, 63 aa, Homo sapiens
  Payload ID: 3201
  Gene Symbol: C17orf62
  Gene Name: chromosome 17 open reading frame 62
  ENSP ID: ENSP00000342228
MVVLRLATGFSHPLTQSAVMGHRSDVEAIAKLITSFLELHCLESPTELSQSSDSEAGDPASQS

SEQ ID NO: 16091 - protein, 187 aa, Homo sapiens; identical to SEQ ID NO: 16088
  Payload ID: 3201
  Gene Symbol: C17orf62
  Gene Name: chromosome 17 open reading frame 62
  Uniprot ID: Q9BQA9
  ENSP ID: ENSP00000388909

SEQ ID NO: 16092 - protein, 173 aa, Homo sapiens
  Payload ID: 3201
  Gene Symbol: C17orf62
  Gene Name: chromosome 17 open reading frame 62
  Uniprot ID: Q9BQA9
  ENSP ID: ENSP00000401626
MYLQVETRTSSRLHLKRAPGIRSWSLLVDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRSDVEAIAKLITSFLELHCLESPTELSQSSDSEAGDPASQS

SEQ ID NO: 16093 - protein, 80 aa, Homo sapiens
  Payload ID: 3201
  Gene Symbol: C17orf62
  Gene Name: chromosome 17 open reading frame 62
  ENSP ID: ENSP00000462346
MYLQVETRTSSRLHLKRAPGIRSWSLLVGILSIGLAAAYYSGGSHLRQEHREGCFEDVQPLQEAADSFQSWPRPGGGPAP

SEQ ID NO: 16094 - protein, 78 aa, Homo sapiens
  Payload ID: 3201
  Gene Symbol: C17orf62
  Gene Name: chromosome 17 open reading frame 62
  ENSP ID: ENSP00000462410
MYLQVETRTSSRLHLKRAPGIRSWSLLVGILSIGLAAAYYSGDSLGWKLFYVTGCLFVAVQNLEDWESWPRPGGGPAP

SEQ ID NO: 16095 - protein, 190 aa, Homo sapiens
  Payload ID: 3201
  Gene Symbol: C17orf62
  Gene Name: chromosome 17 open reading frame 62
  ENSP ID: ENSP00000462515
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRRTRGTFPVCLSPCTAHRTRGLGFSWCLQPSWPIACSCCCLHTA

SEQ ID NO: 16096 - protein, 187 aa, Homo sapiens; identical to SEQ ID NO: 16088
  Payload ID: 3201
  Gene Symbol: C17orf62
  Gene Name: chromosome 17 open reading frame 62
  Uniprot ID: Q9BQA9
  ENSP ID: ENSP00000462529

SEQ ID NO: 16097 - protein, 88 aa, Homo sapiens
  Payload ID: 3201
  Gene Symbol: C17orf62
  Gene Name: chromosome 17 open reading frame 62
  ENSP ID: ENSP00000462956
VVLKTFSLYKKLLTLFRAGHDQVVVLLHDVRDVSVEEEKVRYFGKGYMVVLRLATGFSHPLTQSAVMGHRSVLSLVDIPSGQVLPQGQ

SEQ ID NO: 16098 - protein, 78 aa, Homo sapiens
  Payload ID: 3201
  Gene Symbol: C17orf62
  Gene Name: chromosome 17 open reading frame 62
  ENSP ID: ENSP00000462997
MYLQVETRTSSRLHLKRAPGIRSWSLLESCRLAWLLPTTAEIAWAGSSSTSQAACLWLCRTWRTGRKPSSTRAQGRLF

SEQ ID NO: 16099 - protein, 130 aa, Homo sapiens
  Payload ID: 3201
  Gene Symbol: C17orf62
  Gene Name: chromosome 17 open reading frame 62
  ENSP ID: ENSP00000463215
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKGYMVVLRL

SEQ ID NO: 16100 - protein, 187 aa, Homo sapiens; identical to SEQ ID NO: 16088
  Payload ID: 3201
  Gene Symbol: C17orf62
  Gene Name: chromosome 17 open reading frame 62
  Uniprot ID: Q9BQA9
  ENSP ID: ENSP00000463228

SEQ ID NO: 16101 - protein, 51 aa, Homo sapiens
  Payload ID: 3201
  Gene Symbol: C17orf62
  Gene Name: chromosome 17 open reading frame 62
  ENSP ID: ENSP00000463306
MYLQVETRTSSRLHLKRAPGIRSWSLLVGRQSLSLHRNLVDWPGCCLLQRR

SEQ ID NO: 16102 - protein, 119 aa, Homo sapiens
  Payload ID: 3201
  Gene Symbol: C17orf62
  Gene Name: chromosome 17 open reading frame 62
  ENSP ID: ENSP00000463475
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRY

SEQ ID NO: 16103 - protein, 59 aa, Homo sapiens
  Payload ID: 3201
  Gene Symbol: C17orf62
  Gene Name: chromosome 17 open reading frame 62
  ENSP ID: ENSP00000463840
  MOD_RES (1)..(1): Any amino acid
XKGYMVVLRLATGFSHPLTQSAVMGHRSRRSRQPWTPALGHSKTSGEWRGGARPGPCGC

SEQ ID NO: 16104 - protein, 187 aa, Homo sapiens; identical to SEQ ID NO: 16088
  Payload ID: 3201
  Gene Symbol: C17orf62
  Gene Name: chromosome 17 open reading frame 62
  Uniprot ID: Q9BQA9
  ENSP ID: ENSP00000463846

SEQ ID NO: 16105 - protein, 187 aa, Homo sapiens; identical to SEQ ID NO: 16088
  Payload ID: 3201
  Gene Symbol: C17orf62
  Gene Name: chromosome 17 open reading frame 62
  Uniprot ID: Q9BQA9
  ENSP ID: ENSP00000464080

SEQ ID NO: 16106 - protein, 148 aa, Homo sapiens
  Payload ID: 3201
  Gene Symbol: C17orf62
  Gene Name: chromosome 17 open reading frame 62
  ENSP ID: ENSP00000464201
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRR

SEQ ID NO: 16107 - protein, 117 aa, Homo sapiens
  Payload ID: 3201
  Gene Symbol: C17orf62
  Gene Name: chromosome 17 open reading frame 62
  ENSP ID: ENSP00000464442
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKV

SEQ ID NO: 16108 - protein, 85 aa, Homo sapiens
  Payload ID: 3201
  Gene Symbol: C17orf62
  Gene Name: chromosome 17 open reading frame 62
  ENSP ID: ENSP00000464531
MYLQVETRTSSRLHLKRAPGIRSWSLLVDSLGWKLFYVTGCLFVAVQNLEDWEEAIFDKSTGKVVLKTFSLYKKLLTLFRAGHDQ

SEQ ID NO: 16109 - protein, 173 aa, Homo sapiens; identical to SEQ ID NO: 16092
  Payload ID: 3201
  Gene Symbol: C17orf62
  Gene Name: chromosome 17 open reading frame 62
  Uniprot ID: Q9BQA9
  ENSP ID: ENSP00000464633

SEQ ID NO: 16110 - protein, 63 aa, Homo sapiens; identical to SEQ ID NO: 16090
  Payload ID: 3201
  Gene Symbol: C17orf62
  Gene Name: chromosome 17 open reading frame 62
  ENSP ID: ENSP00000488983

SEQ ID NO: 16111 - protein, 63 aa, Homo sapiens; identical to SEQ ID NO: 16090
  Payload ID: 3201
  Gene Symbol: C17orf62
  Gene Name: chromosome 17 open reading frame 62
  ENSP ID: ENSP00000489034

SEQ ID NO: 16112 - protein, 17 aa, Homo sapiens
  Payload ID: 3201
  Gene Symbol: C17orf62
  Gene Name: chromosome 17 open reading frame 62
  ENSP ID: ENSP00000489093
MVVLRLATGFSHPLTQS

SEQ ID NO: 16113 - protein, 63 aa, Homo sapiens; identical to SEQ ID NO: 16090
  Payload ID: 3201
  Gene Symbol: C17orf62
  Gene Name: chromosome 17 open reading frame 62
  ENSP ID: ENSP00000489494

SEQ ID NO: 16114 - protein, 236 aa, Homo sapiens
  Payload ID: 3202
  Gene Symbol: C17orf64
  Gene Name: chromosome 17 open reading frame 64
  Uniprot ID: Q86WR6
  ENSP ID: ENSP00000269127
MEASDGQGGEGDKPLEQVTNVSCLETSSSASPARDSLMRHAKGLDQDTFKTCKEYLRPLKKFLRKLHLPRDLPQKKKLKYMKQSLVVLGDHINTFLQHYCQAWEIKHWRKMLWRFISLFSELEAKQLRRLYKYTKSSQPAKFLVTFCASDAPERSLLADREDSLPKLCHAWGLHSNISGMKERLSNMQTPGQGSPLPGQPRSQDHVKKDSLRELSQKPKLKRKRIKEAPETPETEP

SEQ ID NO: 16115 - protein, 98 aa, Homo sapiens
  Payload ID: 3202
  Gene Symbol: C17orf64
  Gene Name: chromosome 17 open reading frame 64
  ENSP ID: ENSP00000467637
MRHAKGLDQDTFKTCKEYLRPLKKFLRKLHLPRDLPQKKKLKYMKQSLVVLGDHINTFLQHYCQAWEIKHWRKMLWRFISLFSELEAKQLRRLYKYTK

SEQ ID NO: 16116 - protein, 9 aa, Homo sapiens
  Payload ID: 3202
  Gene Symbol: C17orf64
  Gene Name: chromosome 17 open reading frame 64
  ENSP ID: ENSP00000468617
MRHAKGLDQ

SEQ ID NO: 16117 - protein, 90 aa, Homo sapiens
  Payload ID: 3203
  Gene Symbol: C17orf67
  Gene Name: chromosome 17 open reading frame 67
  Uniprot ID: Q0P5P2
  ENSP ID: ENSP00000380959
MKTLPVLVLSLTLLTVFSETSPILTEKQAKQLLRSRRQDRPSKPGFPDEPMREYMHHLLALEHRAEEQFLEHWLNPHCKPHCDRNRIHPV

SEQ ID NO: 16118 - protein, 501 aa, Homo sapiens
  Payload ID: 3204
  Gene Symbol: C17orf74
  Gene Name: chromosome 17 open reading frame 74
  Uniprot ID: Q0P670
  ENSP ID: ENSP00000328061
MENQLWHNTVRCCNQYQESPHDAEDILLLLLGLIVLVNIGINVATMMWHGLQNALDKMIDWATQKNEIQASESPPSGPPDKAQDVHIHCILDPVQVKMSRPTQYSSFSCHHFSNHHSSSLLRCVRRRRRRHRRCRRRCCNHQQRPQNYRQIPHSHSVFRNPHRSQKMSQLHRVPFFDQEDPDSYLEEEDNLPFPYPKYPRRGWGGFYQRAGLPSNVGLWGHQGGILASLPPPSLYLSPELRCMPKRVEARSELRLQSYGRHGSQSRLWGNVEAEQWASSPPPPHRLPPNPSWVPVGHSPYPSVGWMLYDSWDQRRRGTEGFERPPASVSRNARPEAQGCREHHSPQSHQQSLLGHAYGQSHRSPHPSTEPLGYSSQDPREVRRRAADWAEALPAWRPLTTSASLTVLDEASHQRTPAPSSVLVPHSSQPWPKVQAADPAPPPTMFVPLSRNPGGNANYQVYDSLELKRQVQKSRARSSSLPPASTSTLRPSLHRSQTEKLN

SEQ ID NO: 16119 - protein, 125 aa, Homo sapiens
  Payload ID: 3204
  Gene Symbol: C17orf74
  Gene Name: chromosome 17 open reading frame 74
  ENSP ID: ENSP00000458799
MENQLWHNTVRCCNQYQESPHDAEDILLLLLGLIVLVNIGINVATMMWHGLQNALDKMIDWATQKRGPGFLPGGGGQPALPVSQVPTSRLGRVLSESGPALQCGAVGPPGWYPGQSATTLSLPVT

SEQ ID NO: 16120 - protein, 396 aa, Homo sapiens [sequence omitted]

SEQ ID NO: 16121 - protein, 275 aa, Homo sapiens
  Payload ID: 3205
  Gene Symbol: C17orf75
  Gene Name: chromosome 17 open reading frame 75
  ENSP ID: ENSP00000462127
MDGDEKELESSEEGGSAEERRLEPPSSSHYCLYSYRGSRLAQQRGDSEDGSPSGTNAETPSGDDFSLSLADTNLPSEVEPELRSFIAKRLSRGAVFEGLGNVASVELKIPGYRVGCYYCLFQNEKLLPETVTIDSERNPSEYVVCFLGGSEKGLELFRLELDKYIQGLKNNMNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSS

SEQ ID NO: 16122 - protein, 97 aa, Homo sapiens
  Payload ID: 3205
  Gene Symbol: C17orf75
  Gene Name: chromosome 17 open reading frame 75
  ENSP ID: ENSP00000462873
  MOD_RES (1)..(1): Any amino acid
XLLFQEKLTFLLHAALSYTPVEVKESDEKTKRDINRFLSVASLQGLIHEGTMTSLCMAMTEEQHKSVVIDCSSSQPQFCNAEILDPPPLLFTLSHPS

SEQ ID NO: 16123 - protein, 75 aa, Homo sapiens
  Payload ID: 3205
  Gene Symbol: C17orf75
  Gene Name: chromosome 17 open reading frame 75
  ENSP ID: ENSP00000463184
MLPSLQESMDGDEKELESSEEGGSAEERRLEPPSSSHYCLYSYRGSRLAQQRGDSEDGSPSGTNAETPSGDDFRY

SEQ ID NO: 16124 - protein, 396 aa, Homo sapiens
  Payload ID: 3205
  Gene Symbol: C17orf75
  Gene Name: chromosome 17 open reading frame 75
  Uniprot ID: Q9HAS0
  ENSP ID: ENSP00000464275
MLPSLQESMDGDEKELESSEEGGSAEERRLEPPSSSHYCLYSYRGSRLAQQRGDSEDGSPSGTNAETPSGDDFSLSLADTNLPSEVEPELRSFIAKRLSRGAVFEGLGNVASVELKIPGYRVGCYYCLFQNEKLLPETVTIDSERNPSEYVVCFLGGSEKGLELFRLELDKYIQGLKNNMNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSSQPQFCNAGSNRFCEDWMQAFLNGAKGGNPFLFRQVLENFKLKAIQDTNNLKRFIRQAEMNHYALFKCYMFLKNCGSGDILLKIVKVEHEEMPEAKNVIAVLEEFMKEALDQSF

SEQ ID NO: 16125 - protein, 48 aa, Homo sapiens
  Payload ID: 3205
  Gene Symbol: C17orf75
  Gene Name: chromosome 17 open reading frame 75
  ENSP ID: ENSP00000464416
  MOD_RES (1)..(1): Any amino acid
XAMTEEQHKSVVIDCSSSQPQFCNAGHTRHKQFEEIYPTGRNESLCFV

SEQ ID NO: 16126 - protein, 132 aa, Homo sapiens
  Payload ID: 3205
  Gene Symbol: C17orf75
  Gene Name: chromosome 17 open reading frame 75
  ENSP ID: ENSP00000464759
MNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSSQPQFCNAGSNRFCEDWMQAFLNGAKGGN

SEQ ID NO: 16127 - protein, 88 aa, Homo sapiens
  Payload ID: 3205
  Gene Symbol: C17orf75
  Gene Name: chromosome 17 open reading frame 75
  ENSP ID: ENSP00000464845
MNCEARGLESHIKSYLSSWFEDVVCPIQRVVLLFQEKLTFLLHAALSYTPVEVKESDEKTKRDINRFLSVASLQGLIHEGTMTSLCMA

SEQ ID NO: 16128 - protein, 37 aa, Homo sapiens
  Payload ID: 3205
  Gene Symbol: C17orf75
  Gene Name: chromosome 17 open reading frame 75
  ENSP ID: ENSP00000468451
MNCEARGLESHIKSYLSSWFEDVVCPIQRVVLLFQEK

SEQ ID NO: 16129 - protein, 159 aa, Homo sapiens
  Payload ID: 3206
  Gene Symbol: C17orf78
  Gene Name: chromosome 17 open reading frame 78
  Uniprot ID: Q8N4C9
  ENSP ID: ENSP00000477816
MDTILVFSLIIASYDANKKDLRDSSCRLEQLPGIFPKDVRSIRELQMQETHTETKRTTFIQNRTIATLQCLGSDSKVKVNLVYLERRPKVKHILKNLRIIAAPRRNSSASSSCHLIPTSKFQTGSLLKGKVSMPRSQEAVPMPVVVEMAKEGRPATWDS

SEQ ID NO: 16130 - protein, 275 aa, Homo sapiens
  Payload ID: 3206
  Gene Symbol: C17orf78
  Gene Name: chromosome 17 open reading frame 78
  Uniprot ID: Q8N4C9
  ENSP ID: ENSP00000478886
MDTILVFSLIIASYDANKKDLRDSSCRLEQLPGIFPKDVRSIRELQMQETHTETKRTTFIQNRTIATLQCLGSDSKVKVNLVYLERRPKVKHILKNLRIIAAPRRNSSASSSCHLIPTSKFQTGSLLKGKAFLPGISQCKVLGASSETFPTTAPSITPGNKEGEKTTSTDTDENLEKRQKWSIVVKILIAVTLLLSGVAIIVFVIFEVPCPYQCLGARKLCQCQWLWRWQKKGGQPPGTAESKPDSQPQKVGQDAANSSNPKKAAEITVIHQTYF

SEQ ID NO: 16131 - protein, 275 aa, Homo sapiens; identical to SEQ ID NO: 16130
  Payload ID: 3206
  Gene Symbol: C17orf78
  Gene Name: chromosome 17 open reading frame 78
  Uniprot ID: Q8N4C9
  ENSP ID: ENSP00000484072

SEQ ID NO: 16132 - protein, 159 aa, Homo sapiens; identical to SEQ ID NO: 16129
  Payload ID: 3206
  Gene Symbol: C17orf78
  Gene Name: chromosome 17 open reading frame 78
  Uniprot ID: Q8N4C9
  ENSP ID: ENSP00000488505

SEQ ID NO: 16133 - protein, 547 aa, Homo sapiens
  Payload ID: 3207
  Gene Symbol: C17orf80
  Gene Name: chromosome 17 open reading frame 80
  ENSP ID: ENSP00000255557
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHHCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQGWIRCNTTIRKSGFGGITMLFTGYFVLCCSWSFRRLKLQRWRK

SEQ ID NO: 16134 - protein, 573 aa, Homo sapiens
  Payload ID: 3207
  Gene Symbol: C17orf80
  Gene Name: chromosome 17 open reading frame 80
  Uniprot ID: Q9BSJ5
  ENSP ID: ENSP00000268942
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHHCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQGWIRCNTTIRKSGFGGITMLFTGYFVLCCSWSFRRLKKLCRPLPWKSTVPPCIGVAKTTGDCRSKTCLD

SEQ ID NO: 16135 - protein, 609 aa, Homo sapiens
  Payload ID: 3207
  Gene Symbol: C17orf80
  Gene Name: chromosome 17 open reading frame 80
  Uniprot ID: Q9BSJ5
  ENSP ID: ENSP00000351937
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHHCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQVSLLERSSTHIRSLEPPAGLTTSNFSLMRLLGAVQKGWIRCNTTIRKSGFGGITMLFTGYFVLCCSWSFRRLKKLCRPLPWKSTVPPCIGVAKTTGDCRSKTCLD

SEQ ID NO: 16136 - protein, 583 aa, Homo sapiens
  Payload ID: 3207
  Gene Symbol: C17orf80
  Gene Name: chromosome 17 open reading frame 80
  Uniprot ID: Q9BSJ5
  ENSP ID: ENSP00000396970
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHHCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQVSLLERSSTHIRSLEPPAGLTTSNFSLMRLLGAVQKGWIRCNTTIRKSGFGGITMLFTGYFVLCCSWSFRRLKLQRWRK

SEQ ID NO: 16137 - protein, 609 aa, Homo sapiens; identical to SEQ ID NO: 16135
  Payload ID: 3207
  Gene Symbol: C17orf80
  Gene Name: chromosome 17 open reading frame 80
  Uniprot ID: Q9BSJ5
  ENSP ID: ENSP00000440551

SEQ ID NO: 16138 - protein, 109 aa, Homo sapiens
  Payload ID: 3207
  Gene Symbol: C17orf80
  Gene Name: chromosome 17 open reading frame 80
  ENSP ID: ENSP00000462818
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKAD

SEQ ID NO: 16139 - protein, 180 aa, Homo sapiens
  Payload ID: 3207
  Gene Symbol: C17orf80
  Gene Name: chromosome 17 open reading frame 80
  ENSP ID: ENSP00000463019
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEP

SEQ ID NO: 16140 - protein, 78 aa, Homo sapiens
  Payload ID: 3207
  Gene Symbol: C17orf80
  Gene Name: chromosome 17 open reading frame 80
  ENSP ID: ENSP00000463718
MRLLGAVQKGWIRCNTTIRKSGFGGITMLFTGYFVLCCSWSFRRLKKLCRPLPWKSTVPPCIGVAKTTGDCRSKTCLD

SEQ ID NO: 16141 - protein, 573 aa, Homo sapiens; identical to SEQ ID NO: 16134
  Payload ID: 3207
  Gene Symbol: C17orf80
  Gene Name: chromosome 17 open reading frame 80
  Uniprot ID: Q9BSJ5
  ENSP ID: ENSP00000464132

SEQ ID NO: 16142 - protein, 74 aa, Homo sapiens
  Payload ID: 3208
  Gene Symbol: C17orf89
  Gene Name: chromosome 17 open reading frame 89
  Uniprot ID: A1L188
  ENSP ID: ENSP00000400184
MSANGAVWGRVRSRLRAFPERLAACGAEAAAYGRCVQASTAPGGRLSKDFCAREFEALRSCFAAAAKKTLEGGC

SEQ ID NO: 16143 - protein, 79 aa, Homo sapiens
  Payload ID: 3208
  Gene Symbol: C17orf89
  Gene Name: chromosome 17 open reading frame 89
  ENSP ID: ENSP00000461155
  MOD_RES (1)..(1): Any amino acid
XGRLSKDFCAREFEALRSCFAAAVGQEDAGGRLLGGTLSFTPVCCHGCRALVLMAPGGTYRMPRAERKWEWRRCDIPRC

SEQ ID NO: 16144 - protein, 379 aa, Homo sapiens
  Payload ID: 3209
  Gene Symbol: C17orf96
  Gene Name: chromosome 17 open reading frame 96
  Uniprot ID: A6NHQ4
  ENSP ID: ENSP00000483859
METLCPAPRLAVPASPRGSPCSPTPRKPCRGTQEFSPLCLRALAFCALAKPRASSLGPGPGELAARSPVLRGPQAPLRPGGWAPDGLKHLWAPTGRPGVPNTAAGEDADVAACPRRGEEEEGGGGFPHFGVRSCAPPGRCPAPPHPRESTTSFASAPPRPAPGLEPQRGPAASPPQEPSSRPPSPPAGLSTEPAGPGTAPRPFLPGQPAEVDGNPPPAAPEAPAASPSTASPAPAAPGDLRQEHFDRLIRRSKLWCYAKGFALDTPSLRRGPERPPAKGPARGAAKKRRLPAPPPRTAQPRRPAPTLPTTSTFSLLNCFPCPPALVVGEDGDLKPASSLRLQGDSKPPPAHPLWRWQMGGPAVPEPPGLKFWGINMDES

SEQ ID NO: 16145 - protein, 379 aa, Homo sapiens; identical to SEQ ID NO: 16144
  Payload ID: 3209
  Gene Symbol: C17orf96
  Gene Name: chromosome 17 open reading frame 96
  Uniprot ID: A6NHQ4
  ENSP ID: ENSP00000484710

SEQ ID NO: 16146 - protein, 423 aa, Homo sapiens
  Payload ID: 3210
  Gene Symbol: C17orf97
  Gene Name: chromosome 17 open reading frame 97
  Uniprot ID: Q6ZQX7
  ENSP ID: ENSP00000353245
METRGPGLAVRAESRRLVGIGPRAPPGRVGLQPSGRLDRRGGAGTMGYKDNDGEEEEREGGAAGPRGSRLPPITGGASELAKRKVKKKKRKKKTKGSGKGDDKHQSQSLKSQPLSSSFHDILSPCKERGPKPEHRQSKVEKKHLPSDSSTVSLPDFAEIENLANRINESLRWDGILADPEAEKERIRIYKLNRRKRYRCLALKGFHPDPEALKGFHPDPDALKGFHPDPEALKGFHPDPEALKGIHPDPEALKGFHPDPEALKGFHPDPEALKGFHTDPEALKGFHIDPEALKGFHPDPKALKGFHPDPKALKGFHTDPEALKGFHPDPKALKGFHPDPEALKGFHPDPEALKGFHPDPEALKGFHTDPNAEEAPENLPYLSDKDGSSSHRQPTSKAECPNLCFEGNLTPKLLHSDLAPTLLE

SEQ ID NO: 16147 - protein, 209 aa, Homo sapiens
  Payload ID: 3210
  Gene Symbol: C17orf97
  Gene Name: chromosome 17 open reading frame 97
  ENSP ID: ENSP00000419482
GLAVRAESRRLVGIGPRAPPGRVGLQPSGRLDRRGGAGTMGYKDNDGEEEEREGGAAGPRGSRLPPITGGASELAKRKVKKKKRKKKTKGSGKGDDKHQSQSLKSQPLSSSFHDILSPCKERGPKPEHRQSKVEKKHLPSDSSTVSLPDFAEIENLANRINESLRWDGILADPEAEKERIRIYKLNRRKRWQLQPQAAHVESRVPQSLF

SEQ ID NO: 16148 - protein, 153 aa, Homo sapiens
  Payload ID: 3210
  Gene Symbol: C17orf97
  Gene Name: chromosome 17 open reading frame 97
  ENSP ID: ENSP00000458320
METRGPGLAVRAESRRLVGIGPRAPPGRVGLQPSGRLDRRGGAGTMGYKDNDGEEEEREGGAAGPRGSRLPPITGGASELAKRKVKKKKRKKKTKGSGKGDGILLWGKPAAVLCGLPEERCPPERNDVSAQQHGGPESCYQPHECAWKQVEPS

SEQ ID NO: 16149 - protein, 6 aa, Homo sapiens
  Payload ID: 3210
  Gene Symbol: C17orf97
  Gene Name: chromosome 17 open reading frame 97
  ENSP ID: ENSP00000466848
APTLLE

SEQ ID NO: 16150 - protein, 154 aa, Homo sapiens
  Payload ID: 3211
  Gene Symbol: C17orf98
  Gene Name: chromosome 17 open reading frame 98
  Uniprot ID: A8MV24
  ENSP ID: ENSP00000479396
MAYLSECRLRLEKGFILDGVAVSTAARAYGRSRPKLWSAIPPYNAQQDYHARSYFQSHVVPPLLRKTDQDHGGTGRDGWIVDYIHIFGQGQRYLNRRNWAGTGHSLQQVTGHDHYNADLKPIDGFNGRFGYRRNTPALRQSTSVFGEVTHFPLF

SEQ ID NO: 16151 - protein, 154 aa, Homo sapiens; identical to SEQ ID NO: 16150
  Payload ID: 3211
  Gene Symbol: C17orf98
  Gene Name: chromosome 17 open reading frame 98
  Uniprot ID: A8MV24
  ENSP ID: ENSP00000482299

SEQ ID NO: 16152 - protein, 265 aa, Homo sapiens
  Payload ID: 3212
  Gene Symbol: C17orf99
  Gene Name: chromosome 17 open reading frame 99
  Uniprot ID: Q6UX52
  ENSP ID: ENSP00000343493
MGLPGLFCLAVLAASSFSKAREEEITPVVSIAYKVLEVFPKGRWVLITCCAPQPPPPITYSLCGTKNIKVAKKVVKTHEPASFNLNVTLKSSPDLLTYFCWASSTSGAHVDSARLQMHWELWSKPVSELRANFTLQDRGAGPRVEMICQASSGSPPITNSLIGKDGQVHLQQRPCHRQPANFSFLPSQTSDWFWCQAANNANVQHSALTVVPPGGDQKMEDWQGPLESPILALPLYRSTRRLSEEEFGGFRIGNGEVRGRKAAAM

SEQ ID NO: 16153 - protein, 189 aa, Homo sapiens
  Payload ID: 3212
  Gene Symbol: C17orf99
  Gene Name: chromosome 17 open reading frame 99
  ENSP ID: ENSP00000466133
LIALTSLTAASSFSKAREEEITPVVSIAYKVLEVFPKGRWVLITCCAPQPPPPITYSLCGTKNIKVAKKVVKTHEPASFNLNVTLKSSPDLLTYFCWASSTSGAHVDSARLQMHWELWSKPVSELRANFTLQDRGAGPRVEMICQASSGSPPITNSLIGKDGQVHLQQRPCHRQPANFSFLPSQTSDWF

SEQ ID NO: 16154 - protein, 151 aa, Homo sapiens
  Payload ID: 3212
  Gene Symbol: C17orf99
  Gene Name: chromosome 17 open reading frame 99
  ENSP ID: ENSP00000487393
  MOD_RES (1)..(1): Any amino acid
XQPPPPITYSLCGTKNIKVAKKVVKTHEPASFNLNVTLKSSPDLLTYFCWASSTSGAHVDSARLQMHWELWSRQRGRPQGGDDLPGVLGQPTYHQQPDREGWAGPPAAETMPQAACQLLLPAEPDIGLVLVPGCKQRQCPAQRPHSGAPRW

SEQ ID NO: 16155 - protein, 110 aa, Homo sapiens
  Payload ID: 3213
  Gene Symbol: C18orf21
  Gene Name: chromosome 18 open reading frame 21
  ENSP ID: ENSP00000269194
MVKKFKDSKSVLLITCKTCNRTVKHHGKSRSFVSTLKSNPATPTSKLSLKTPERRTANPNHDMSGSKGKSPASVFRTPTSGQSVSTCSSKNTSKTKKHFSQLKMLLSQNE

SEQ ID NO: 16156 - protein, 132 aa, Homo sapiens
  Payload ID: 3213
  Gene Symbol: C18orf21
  Gene Name: chromosome 18 open reading frame 21
  Uniprot ID: Q32NC0
  ENSP ID: ENSP00000329492
MVKKFKDSKSVLLITCKTCNRTVKHHGKSRSFVSTLKSNPATPTSKLSLKTPERRTANPNHDMSGSKGKSPASVFRTPTSGQSVSTCSSKNTSKTKKHFSQLKMLLSQNESQKIPKVDFRNFLSSLKGGLLK

SEQ ID NO: 16157 - protein, 220 aa, Homo sapiens
  Payload ID: 3213
  Gene Symbol: C18orf21
  Gene Name: chromosome 18 open reading frame 21
  Uniprot ID: Q32NC0
  ENSP ID: ENSP00000465517
MRQKHYLEAAARGLHDSCPGQARYLLWAYTSSHDDKSTFEETCPYCFQLLVLDNSRVRLKPKARLTPKIQKLLNREARNYTLSFKEAKMVKKFKDSKSVLLITCKTCNRTVKHHGKSRSFVSTLKSNPATPTSKLSLKTPERRTANPNHDMSGSKGKSPASVFRTPTSGQSVSTCSSKNTSKTKKHFSQLKMLLSQNESQKIPKVDFRNFLSSLKGGLLK

SEQ ID NO: 16158 - protein, 88 aa, Homo sapiens
  Payload ID: 3213
  Gene Symbol: C18orf21
  Gene Name: chromosome 18 open reading frame 21
  ENSP ID: ENSP00000466400
MVKKFKDSKSVLLITCKTCNRTVKHHGKSRSFVSTLKSNPATPTSKLSLKTPERRTANPNHDMSGSKGKSPASVFRTPTSGQSVSTCS

SEQ ID NO: 16159 - protein, 132 aa, Homo sapiens; identical to SEQ ID NO: 16156
  Payload ID: 3213
  Gene Symbol: C18orf21
  Gene Name: chromosome 18 open reading frame 21
  Uniprot ID: Q32NC0
  ENSP ID: ENSP00000480486

SEQ ID NO: 16160 - protein, 130 aa, Homo sapiens
  Payload ID: 3213
  Gene Symbol: C18orf21
  Gene Name: chromosome 18 open reading frame 21
  ENSP ID: ENSP00000483334
MRQKHYLEAAARGLHDSCPGQARYLLWAYTSSHDDKSTFEETCPYCFQLLVLDNSRVRLKPKARLTPKIQKLLNREARNYTLSFKEAKMVKKFKDSKSVLNTYIWTVSIYLLLKEHQQNKETLLSTKNVT

SEQ ID NO: 16161 - protein, 146 aa, Homo sapiens
  Payload ID: 3214
  Gene Symbol: C18orf25
  Gene Name: chromosome 18 open reading frame 25
  ENSP ID: ENSP00000467826
MKMEEAVGKVEELIESEAPPKASEQETAKEEDGSVELESQVQKDGVADSTVISSMPCLLMELRRDSSESQLASTESDKPTTGRVYESDSSNHCMLSPSSSGHLADSDTLSSAEENEPSQAETAVEGDPSGVSGATVGRKSRRSRSE

SEQ ID NO: 16162 - protein, 103 aa, Homo sapiens
  Payload ID: 3214
  Gene Symbol: C18orf25
  Gene Name: chromosome 18 open reading frame 25
  ENSP ID: ENSP00000468128
MAAKKNRQSSDKQNGRVAKVKGHRSQKHKERIRLLRQKREAAARKKYNLLQDSSTSDSDLTCDSSTSSSDDDEEVSGSSKTITAEIPDGPPVVAHYDMSDTNS

SEQ ID NO: 16163 - protein, 275 aa, Homo sapiens
  Payload ID: 3214
  Gene Symbol: C18orf25
  Gene Name: chromosome 18 open reading frame 25
  ENSP ID: ENSP00000479398
MKMEEAVGKVEELIESEAPPKASEQETAKEEDGSVELESQVQKDGVADSTVISSMPCLLMELRRDSSESQLASTESDKPTTGRVYESDSSNHCMLSPSSSGHLADSDTLSSAEENEPSQAETAVEGDPSGVSGATVGRKSRRSRSESETSTMAAKKNRQSSDKQNGRVAKVKGHRSQKHKERIRLLRQKREAAARKKYNLLQDSSTSDSDLTCDSSTSSSDDDEEVSGSSKTITAEIPGTGFCYVVQAGLRRLGLSDLHTLASQSAEILWDSHLA

SEQ ID NO: 16164 - protein, 343 aa, Homo sapiens
  Payload ID: 3214
  Gene Symbol: C18orf25
  Gene Name: chromosome 18 open reading frame 25
  Uniprot ID: Q96B23
  ENSP ID: ENSP00000480074
MKMEEAVGKVEELIESEAPPKASEQETAKEEDGSVELESQVQKDGVADSTVISSMPCLLMELRRDSSESQLASTESDKPTTGRVYESDSSNHCMLSPSSSGHLADSDTLSSAEENEPSQAETAVEGDPSGVSGATVGRKSRRSRSESETSTMAAKKNRQSSDKQNGRVAKVKGHRSQKHKERIRLLRQKREAAARKKYNLLQDSSTSDSDLTCDSSTSSSDDDEEVSGSSKTITAEIPGHLDPGFLASDKTSAGNAPLNEEINIASSDSEVEIVGVQEHARCVHPRGGVIQSVSSWKHGSGTQYVSTRQTQSWTAVTPQQTWASPAEVVDLTLDEDSRRKYLL

SEQ ID NO: 16165 - protein, 404 aa, Homo sapiens
  Payload ID: 3214
  Gene Symbol: C18orf25
  Gene Name: chromosome 18 open reading frame 25
  ENSP ID: ENSP00000481626
MKMEEAVGKVEELIESEAPPKASEQETAKEEDGSVELESQVQKDGVADSTVISSMPCLLMELRRDSSESQLASTESDKPTTGRVYESDSSNHCMLSPSSSGHLADSDTLSSAEENEPSQAETAVEGDPSGVSGATVGRKSRRSRSESETSTMAAKKNRQSSDKQNGRVAKVKGHRSQKHKERIRLLRQKREAAARKKYNLLQDSSTSDSDLTCDSSTSSSDDDEEVSGSSKTITAEIPDGPPVVAHYDMSDTNSDPEVVNVDNLLAAAVVQEHSNSVGGQDTGATWRTSGLLEELNAEAGHLDPGFLASDKTSAGNAPLNEEINIASSDSEVEIVGVQEHARCVHPRGGVIQSVSSWKHGSGTQYVSTRQTQSWTAVTPQQTWASPAEVVDLTLDEDSRRKYLL

SEQ ID NO: 16166 - protein, 76 aa, Homo sapiens
  Payload ID: 3215
  Gene Symbol: C18orf32
  Gene Name: chromosome 18 open reading frame 32
  Uniprot ID: Q8TCD1
  ENSP ID: ENSP00000323199
MVCIPCIVIPVLLWIYKKFLEPYIYPLVSPFVSRIWPKKAIQESNDTNKGKVNFKGADMNGLPTKGPTEICDKKKD

SEQ ID NO: 16167 - protein, 76 aa, Homo sapiens; identical to SEQ ID NO: 16166
  Payload ID: 3215
  Gene Symbol: C18orf32
  Gene Name: chromosome 18 open reading frame 32
  Uniprot ID: Q8TCD1
  ENSP ID: ENSP00000462538

SEQ ID NO: 16168 - protein, 76 aa, Homo sapiens; identical to SEQ ID NO: 16166
  Payload ID: 3215
  Gene Symbol: C18orf32
  Gene Name: chromosome 18 open reading frame 32
  Uniprot ID: Q8TCD1
  ENSP ID: ENSP00000480941

SEQ ID NO: 16169 - protein, 69 aa, Homo sapiens
  Payload ID: 3216
  Gene Symbol: C18orf42
  Gene Name: chromosome 18 open reading frame 42
  Uniprot ID: P0CW23
  ENSP ID: ENSP00000399075
MVFAPGEKPGNEPEEVKLQNASKQIVQNAILQAVQQVSQESQRREERISDNRDHIQLGVGELTKKHEKK

SEQ ID NO: 16170 - protein, 76 aa, Homo sapiens
  Payload ID: 3216
  Gene Symbol: C18orf42
  Gene Name: chromosome 18 open reading frame 42
  ENSP ID: ENSP00000462259
MSVQYPRRRATAGEKPGNEPEEVKLQNASKQIVQNAILQAVQQVSQESQRREERISDNRDHIQLGVGELTKKHEKK

SEQ ID NO: 16171 - protein, 372 aa, Homo sapiens
  Payload ID: 3217
  Gene Symbol: C18orf54
  Gene Name: chromosome 18 open reading frame 54
  Uniprot ID: Q8IYD9
  ENSP ID: ENSP00000300091
MAKSKTKHRLCSQESSVSALLASCTLSGSNSSNSDGSFHYKDKLYRSASQALQAYIDDFDLGQIYPGASTGKINIDEDFTNMSQFCNYIYKPNNAFENLDHKKHSNFISCRRHTVNDIDSMSLTTDDLLRLPADGSFSYTYVGPSHRTSKKNKKCRGRLGSLDIEKNPHFQGPYTSMGKDNFVTPVIRSNINGKQCGDKIELLILKAKRNLEQCTEELPKSMKKDDSPCSLDKLEADRSWENIPVTFKSPVPVNSDDSPQQTSRAKSAKGVLEDFLNNDNQSCTLSGGKHHGPVEALKQMLFNLQAVQERFNQNKTTDPKEEIKQVSEDDFSKLQLKESMIPITRSLQKALHHLSRLRDLVDDTNGERSPKM

SEQ ID NO: 16172 - protein, 533 aa, Homo sapiens
  Payload ID: 3217
  Gene Symbol: C18orf54
  Gene Name: chromosome 18 open reading frame 54
  Uniprot ID: Q8IYD9
  ENSP ID: ENSP00000372368
MAKSKTKHRLCSQESSVSALLASCTLSGSNSSNSDGSFHYKDKLYRSASQALQAYIDDFDLGQIYPGASTGKINIDEDFTNMSQFCNYIYKPNNAFENLDHKKHSNFISCRRHTVNDIDSMSLTTDDLLRLPADGSFSYTYVGPSHRTSKKNKKCRGRLGSLDIEKNPHFQGPYTSMGKDNFVTPVIRSNINGKQCGRLKNPKLMNRTNNCISESSLSFPKKSSFKDSSEHSLEKNYPRWLTSQKSDLNVSGITSIPDFKYPVWLHNQDLLPDANSQRVYQIFKDDQCSPRHSHQAQGTSRLINKLDCFEYAFEPSNFSNSLSDDKELVNEYKCDFEHSQCQCENPLLPGQSTKPFSGDKIELLILKAKRNLEQCTEELPKSMKKDDSPCSLDKLEADRSWENIPVTFKSPVPVNSDDSPQQTSRAKSAKGVLEDFLNNDNQSCTLSGGKHHGPVEALKQMLFNLQAVQERFNQNKTTDPKEEIKQVSEDDFSKLQLKESMIPITRSLQKALHHLSRLRDLVDDTNGERSPKM

SEQ ID NO: 16173 - protein, 35 aa, Homo sapiens
  Payload ID: 3217
  Gene Symbol: C18orf54
  Gene Name: chromosome 18 open reading frame 54
  ENSP ID: ENSP00000462201
ESMIPITRSLQKALHHLSRLRDLVDDTNGERSPKM

SEQ ID NO: 16174 - protein, 151 aa, Homo sapiens
  Payload ID: 3217
  Gene Symbol: C18orf54
  Gene Name: chromosome 18 open reading frame 54
  ENSP ID: ENSP00000462317
MKKDDSPCSLDKLEADRSWENIPVTFKSPVPVNSDDSPQQTSRAKSAKGVLEDFLNNDNQSCTLSGGKHHGPVEALKQMLFNLQAVQERFNQNKTTDPKEEIKQVSEDDFSKLQLKESMIPITRSLQKALHHLSRLRDLVDDTNGERSPKM

SEQ ID NO: 16175 - protein, 533 aa, Homo sapiens; identical to SEQ ID NO: 16172
  Payload ID: 3217
  Gene Symbol: C18orf54
  Gene Name: chromosome 18 open reading frame 54
  Uniprot ID: Q8IYD9
  ENSP ID: ENSP00000477654

SEQ ID NO: 16176 - protein, 685 aa, Homo sapiens
  Payload ID: 3218
  Gene Symbol: C18orf63
  Gene Name: chromosome 18 open reading frame 63
  Uniprot ID: Q68DL7
  ENSP ID: ENSP00000464330
MNDSRQQSLFFITLPDLNKLCAVRIILSNKVADTEIRTIQMKMCRQLLFLHQDILTSPVSGILNQIWVVMAIPFYKARKLNAYVEKYGAKMEAPQRVIPVILQNCLSYSFMARLAPAWNRTGHLLIQGRDFLSQMGKQSAVVLNINVTETQVCLSIEACTIRLPAPELKEFEISQSIIKDFHANKHAVIERHSILSNWCYVLPSMKMGQIINIFHAIPAACPFHSYGDFQRHWDALYGYKLPGDCGKIKIYCNIYFKMLGERTFTYPLSCIRSQPMQFFPRVDSEVVLKSFLSDLKSKLPHICGFPIKMTSKPCYYTQELTKPNIQEHKVKPPNLTTKKMLRASLTQATSRKPACAQSLLPCSVAVDHKVELSVSQPTSGIFSALHLQPESVQGRKKSLSIRAPQVHSEVLMPNRGNTQVQHTNLSSQSNITPKFVPVFKNRLLQMNKNTSVLGSPKRKQHDVTQSKLFSLKTSMIQHDKLNLGPAIKNRYSSNIQMQAANNLNQENSRPLQEKNTESSENMTKFPSSRGKSTVSLNKNKQLSNSAVFVVSNNNLGVVKSAVDFQMKGKENLTGKGITQILGKSHGSLKLKRQPHIFESDGETEDPRLLQQQSENQAKEVGTSDHRLIVSKIAHRSKRKLCPESSKTSKKHHSDTVHYGQSSSSKKQILDSDKSKLKKSLIIHNA

SEQ ID NO: 16177 - protein, 657 aa, Homo sapiens
  Payload ID: 3219
  Gene Symbol: C18orf8
  Gene Name: chromosome 18 open reading frame 8
  Uniprot ID: Q96DM3
  ENSP ID: ENSP00000269221
MGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 16178 - protein, 333 aa, Homo sapiens
  Payload ID: 3219
  Gene Symbol: C18orf8
  Gene Name: chromosome 18 open reading frame 8
  ENSP ID: ENSP00000464875
MGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPNFL

SEQ ID NO: 16179 - protein, 66 aa, Homo sapiens
  Payload ID: 3219
  Gene Symbol: C18orf8
  Gene Name: chromosome 18 open reading frame 8
  ENSP ID: ENSP00000465956
MGEEDYYLELCERPVQFEKANPVNCVFFDEANKQVFAVRSGGATGVVVKGPDDRNPISFRLRMPTF

SEQ ID NO: 16180 - protein, 609 aa, Homo sapiens
  Payload ID: 3219
  Gene Symbol: C18orf8
  Gene Name: chromosome 18 open reading frame 8
  ENSP ID: ENSP00000467007
MGEEDYYLELCERPVQFEKANPVNCVFFDEANKQVFAVRSGGATGVVVKGPDDRNPISFRMDDKGEVKCIKFSLENKILAVQRTSKTVVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 16181 - protein, 154 aa, Homo sapiens
  Payload ID: 3219
  Gene Symbol: C18orf8
  Gene Name: chromosome 18 open reading frame 8
  ENSP ID: ENSP00000467692
MGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKGGLFGEERCIPTTVLPALQWPRVKRPSARPFSNLSALKRVGLRMPTF

SEQ ID NO: 16182 - protein, 85 aa, Homo sapiens
  Payload ID: 3219
  Gene Symbol: C18orf8
  Gene Name: chromosome 18 open reading frame 8
  ENSP ID: ENSP00000467852
MGEEDYYLELCERPVQFEKANPVNCVFFDEANKQVFAVRSGGATGVVVKGPDDRNPISFRIFVILSLIIPSWNTHRSARLRMPTF

SEQ ID NO: 16183 - protein, 561 aa, Homo sapiens
  Payload ID: 3219
  Gene Symbol: C18orf8
  Gene Name: chromosome 18 open reading frame 8
  ENSP ID: ENSP00000482573
MGEEDYYLELCERPVQFEKANPVNCVFFDEANKQVFAVRSGGATGVVVKGPDDRNPISFRMDDKGEVKCIKFSLENKILAVQRTSKTVVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKMLQSRLKTTCFSIQYSAFLNSETSVCEGAPISHQGNTVKNMLLFSNRFLETKL

SEQ ID NO: 16184 - protein, 141 aa, Homo sapiens
  Payload ID: 3220
  Gene Symbol: C19orf12
  Gene Name: chromosome 19 open reading frame 12
  Uniprot ID: Q9NSK7
  ENSP ID: ENSP00000313332
MTIMVEDIMKLLCSLSGERKMKAAVKHSGKGALVTGAMAFVGGLVGGPPGLAVGGAVGGLLGAWMTSGQFKPVPQILMELPPAEQQRLFNEAAAIIRHLEWTDAVQLTALVMGSEALQQQLLAMLVNYVTKELRAEIQYDD

SEQ ID NO: 16185 - protein, 68 aa, Homo sapiens
  Payload ID: 3220
  Gene Symbol: C19orf12
  Gene Name: chromosome 19 open reading frame 12
  ENSP ID: ENSP00000345497
MTIMVEDIMKLLCSLSGERKMKAAVKHSGKGALVTGAMAFVGGLVGGPPGLAVGSSLRHRIALNRLLS

SEQ ID NO: 16186 - protein, 77 aa, Homo sapiens
  Payload ID: 3220
  Gene Symbol: C19orf12
  Gene Name: chromosome 19 open reading frame 12
  Uniprot ID: Q9NSK7
  ENSP ID: ENSP00000376102
MTSGQFKPVPQILMELPPAEQQRLFNEAAAIIRHLEWTDAVQLTALVMGSEALQQQLLAMLVNYVTKELRAEIQYDD

SEQ ID NO: 16187 - protein, 152 aa, Homo sapiens
  Payload ID: 3220
  Gene Symbol: C19orf12
  Gene Name: chromosome 19 open reading frame 12
  Uniprot ID: Q9NSK7
  ENSP ID: ENSP00000376103
MERLKSHKPATMTIMVEDIMKLLCSLSGERKMKAAVKHSGKGALVTGAMAFVGGLVGGPPGLAVGGAVGGLLGAWMTSGQFKPVPQILMELPPAEQQRLFNEAAAIIRHLEWTDAVQLTALVMGSEALQQQLLAMLVNYVTKELRAEIQYDD

SEQ ID NO: 16188 - protein, 107 aa, Homo sapiens
  Payload ID: 3220
  Gene Symbol: C19orf12
  Gene Name: chromosome 19 open reading frame 12
  Uniprot ID: Q9NSK7
  ENSP ID: ENSP00000467117
MTIMVEDIMKLLCSLSGERKMKAAVKHSGKGALVTGAMAFVGGLVGGPPGLAVGGAVGGLLGAWMTSGQFKPVPQILMELPPAEQQRLFNEAAAIIRPCSSSCWPCW

SEQ ID NO: 16189 - protein, 106 aa, Homo sapiens
  Payload ID: 3220
  Gene Symbol: C19orf12
  Gene Name: chromosome 19 open reading frame 12
  ENSP ID: ENSP00000467516
MTIMVEDIMKLLCSLSGERKMKAAVKHSGKGALVTGAMAFVGGLVGGPPGLAVGGAVGGLLGAWMTSGQFKPVPQILMELPPAEQQRLFNEAAAIIRHLEWTDAVQ

SEQ ID NO: 16190 - protein, 141 aa, Homo sapiens; identical to SEQ ID NO: 16184
  Payload ID: 3220
  Gene Symbol: C19orf12
  Gene Name: chromosome 19 open reading frame 12
  Uniprot ID: Q9NSK7
  ENSP ID: ENSP00000482097

SEQ ID NO: 16191 - protein, 77 aa, Homo sapiens; identical to SEQ ID NO: 16186
  Payload ID: 3220
  Gene Symbol: C19orf12
  Gene Name: chromosome 19 open reading frame 12
  Uniprot ID: Q9NSK7
  ENSP ID: ENSP00000485413

SEQ ID NO: 16192 - protein, 215 aa, Homo sapiens
  Payload ID: 3221
  Gene Symbol: C19orf18
  Gene Name: chromosome 19 open reading frame 18
  Uniprot ID: Q8NEA5
  ENSP ID: ENSP00000321519
MDKVQSGFLILFLFLMECQLHLCLPYADGLHPTGNITGLPGSKRSQPPRNITKEPKVFFHKTQLPGIQGAASRSTAASPTNPMKFLRNKAIIRHRPALVKVILISSVAFSIALICGMAISYMIYRLAQAEERQQLESLYKNLRIPLLGDEEEGSEDEGESTHLLPENENELEKFIHSVIISKRSKNIKKKLKEEQNSVTENKTKNASHNGKMEDL

SEQ ID NO: 16193 - protein, 132 aa, Homo sapiens
  Payload ID: 3222
  Gene Symbol: C19orf24
  Gene Name: chromosome 19 open reading frame 24
  Uniprot ID: Q9BVV8
  ENSP ID: ENSP00000386557
MGPRVLQPPLLLLLLALLLAALPCGAEEASPLRPAQVTLSPPPAVTNGSQPGAPHNSTHTRPPGASGSALTRSFYVILGFCGLTALYFLIRAFRLKKPQRRRYGLLANTEDPTEMASLDSDEETVFESRNLR

SEQ ID NO: 16194 - protein, 132 aa, Homo sapiens
  Payload ID: 3222
  Gene Symbol: C19orf24
  Gene Name: chromosome 19 open reading frame 24
  ENSP ID: ENSP00000473955
MREGQEMGPTPVPSNPLLHRSFPCWPRGWSHPVPTRELLLEPAQPADLLPPAPTAGPCSLASWMLSQPGRGSQVKTGGTPTATAQDAEAPLPDCDLCLSPAPVGTWQPRAKAGWAGDPRNLSGNTFSPGWEQ

SEQ ID NO: 16195 - protein, 158 aa, Homo sapiens
  Payload ID: 3223
  Gene Symbol: C19orf25
  Gene Name: chromosome 19 open reading frame 25
  ENSP ID: ENSP00000389254
MGSKAKKRVLLPTRPAPPTVEQILEDVRGAPAEDPVFTILAPEGRGSPVPGKSGPETPAARGRERSTPLTPDPTPWEPPQHGHDPPVPFRMMEDAEAPGEQLYQQSRAYVAANQRLQQAGNVLRQRCELLQRAGEDLEREVAQMKQAALPAAEAASSG

SEQ ID NO: 16196 - protein, 118 aa, Homo sapiens
  Payload ID: 3223
  Gene Symbol: C19orf25
  Gene Name: chromosome 19 open reading frame 25
  Uniprot ID: Q9UFG5
  ENSP ID: ENSP00000397394
MGSKAKKRVLLPTRPAPPTVEQILEDVRGAPAEDPVFTILAPEDPPVPFRMMEDAEAPGEQLYQQSRAYVAANQRLQQAGNVLRQRCELLQRAGEDLEREVAQMKQAALPAAEAASSG

SEQ ID NO: 16197 - protein, 160 aa, Homo sapiens
  Payload ID: 3223
  Gene Symbol: C19orf25
  Gene Name: chromosome 19 open reading frame 25
  ENSP ID: ENSP00000465469
MGSKAKKRVLLPTRPAPPTVEQILEDVRGAPAEDPVFTILAPEDPPVPFRMMEDAEAPGEQLYQQSRAYVAANQRLQQAGNPRLPPQADLSGPAGLGSAQGGLHPGFPWGSVGPRLAFTGSQPTWVLTQAPLLMLGLRFIRRLIHAELVGPTQLAPSCVT

SEQ ID NO: 16198 - protein, 86 aa, Homo sapiens
  Payload ID: 3223
  Gene Symbol: C19orf25
  Gene Name: chromosome 19 open reading frame 25
  ENSP ID: ENSP00000466283
MGSKAKKRVLLPTRPAPPTVEQILEDVRGAPAEDPVFTILAPEEMGVSLCCPGWSLTLGLKCSSRLGLPKCWITGVSHHTWLHPSC

SEQ ID NO: 16199 - protein, 118 aa, Homo sapiens; identical to SEQ ID NO: 16196
  Payload ID: 3223
  Gene Symbol: C19orf25
  Gene Name: chromosome 19 open reading frame 25
  Uniprot ID: Q9UFG5
  ENSP ID: ENSP00000466372

SEQ ID NO: 16200 - protein, 118 aa, Homo sapiens; identical to SEQ ID NO: 16196
  Payload ID: 3223
  Gene Symbol: C19orf25
  Gene Name: chromosome 19 open reading frame 25
  Uniprot ID: Q9UFG5
  ENSP ID: ENSP00000467861

SEQ ID NO: 16201 - protein, 71 aa, Homo sapiens
  Payload ID: 3223
  Gene Symbol: C19orf25
  Gene Name: chromosome 19 open reading frame 25
  ENSP ID: ENSP00000468000
MGSKAKKRVLLPTRPAPPTVEQILEDVRGAPAEDPVFTILAPEGWSAVARSRLTAGSDSPVQAILLPQPPE

SEQ ID NO: 16202 - protein, 42 aa, Homo sapiens
  Payload ID: 3223
  Gene Symbol: C19orf25
  Gene Name: chromosome 19 open reading frame 25
  ENSP ID: ENSP00000468064
SKAKKRVLLPTRPAPPTVEQILEDVRGAPAEDPVFTILAPEG

SEQ ID NO: 16203 - protein, 118 aa, Homo sapiens; identical to SEQ ID NO: 16196
  Payload ID: 3223
  Gene Symbol: C19orf25
  Gene Name: chromosome 19 open reading frame 25
  Uniprot ID: Q9UFG5
  ENSP ID: ENSP00000468688

SEQ ID NO: 16204 - protein, 78 aa, Homo sapiens
  Payload ID: 3223
  Gene Symbol: C19orf25
  Gene Name: chromosome 19 open reading frame 25
  ENSP ID: ENSP00000478936
MGSKAKKRVLLPTRPAPPTVEQILEDVRGAPAEDPVFTILAPEGDDRGDLISPDPCGTWSLRPWETTLPRGRPEPRGP

SEQ ID NO: 16205 - protein, 106 aa, Homo sapiens
  Payload ID: 3224
  Gene Symbol: C19orf33
  Gene Name: chromosome 19 open reading frame 33
  Uniprot ID: Q9GZP8
  ENSP ID: ENSP00000301246
MEFDLGAALEPTSQKPGVGAGHGGDPKLSPHKVQGRSEAGAGPGPKQGHHSSSDSSSSSSDSDTDVKSHAAGSKQHESIPGKAKKPKVKKKEKGKKEKGKKKEAPH

SEQ ID NO: 16206 - protein, 85 aa, Homo sapiens
  Payload ID: 3224
  Gene Symbol: C19orf33
  Gene Name: chromosome 19 open reading frame 33
  Uniprot ID: Q9GZP8
  ENSP ID: ENSP00000464940
MEFDLGAALEPTSQKPGVGAGHGGDPKLSPHKVQGRSEAGAGPGPKASNFRGLGKGRRLTAAPPSSKDTTALPTPAAAPAIRTRM

SEQ ID NO: 16207 - protein, 473 aa, Homo sapiens
  Payload ID: 3225
  Gene Symbol: C19orf35
  Gene Name: chromosome 19 open reading frame 35
  Uniprot ID: Q6ZS72
  ENSP ID: ENSP00000345102
MSSPEPPTEPPEPDNPTWSTQPTYSNLGQIRAHLLPSKACRLRTPGSLSTNPEPLPPPLPKKILTRTQSLPTRRTLHPSSIQVQPPRRPFLGSHSVDKSQAAVGPACLPAELTFGPADAPLGLSLRDLHSPEAVHTALAARQLQGLRTIYARLRARLMGGHPGPCHPGHSFRLLDSSPCAESGDALYYRVVRAHEDAWHILVAKVPKPGADVPHPWGLELQASLSPHFNLQGLCGLVPEGTLPGAPWRGAVALAAEVPERTVAQWLAEACTQPPEEFVWAVALLLLQLSAALKFLEAWGAALVELRPENLLLVAPRGCATTGPPRLLLTDFGRVCLQPPGPPGSPGPHAPQLGSLLRALLSLAAPSTTPLAAGLELLAAQLTRLRPSASRTRGALQALLWGPGPELRGRGAPLGPWLRALGPWLRVRRGLLVLRLAERAAGGEAPSLEDWLCCEYLAEATESSMGQALALLWD

SEQ ID NO: 16208 - protein, 230 aa, Homo sapiens
  Payload ID: 3226
  Gene Symbol: C19orf38
  Gene Name: chromosome 19 open reading frame 38
  Uniprot ID: A8MVS5
  ENSP ID: ENSP00000380920
MPWTILLFAAGSLAIPAPSIRLVPPYPSSQEDPIHIACMAPGNFPGANFTLYRGGQVVQLLQAPTDQRGVTFNLSGGSSKAPGGPFHCQYGVLGELNQSQLSDLSEPVNVSFPVPTWILVLSLSLAGALFLLAGLVAVALVVRKVKLRNLQKKRDRESCWAQINFDSTDMSFDNSLFTVSAKTMPEEDPATLDDHSGTTATPSNSRTRKRPTSTSSSPETPEFSTFRACQ

SEQ ID NO: 16209 - protein, 230 aa, Homo sapiens; identical to SEQ ID NO: 16208
  Payload ID: 3226
  Gene Symbol: C19orf38
  Gene Name: chromosome 19 open reading frame 38
  Uniprot ID: A8MVS5
  ENSP ID: ENSP00000468568

SEQ ID NO: 16210 - protein, 176 aa, Homo sapiens
  Payload ID: 3227
  Gene Symbol: C19orf43
  Gene Name: chromosome 19 open reading frame 43
  Uniprot ID: Q9BQ61
  ENSP ID: ENSP00000242784
MAARGRRAEPQGREAPGPAGGGGGGSRWAESGSGTSPESGDEEVSGAGSSPVSGGVNLFANDGSFLELFKRKMEEEQRQRQEEPPPGPQRPDQSAAAAGPGDPKRKGGPGSTLSFVGKRRGGNKLALKTGIVAKKQKTEDEVLTSKGDAWAKYMAEVKKYKAHQCGDDDKTRPLVK

SEQ ID NO: 16211 - protein, 132 aa, Homo sapiens
  Payload ID: 3227
  Gene Symbol: C19orf43
  Gene Name: chromosome 19 open reading frame 43
  ENSP ID: ENSP00000466196
MAARGRRAEPQGREAPGPAGGGGGGSRWAESGSGTSPESGDEEVSGAGSSPVSGGVNLFANDGSFLELFKRKMEEEQRQRQEEPPPGPQRPDQSAAAAGPGDPKRKGGGQTQRREQTSPQDGNSSQEAEDGG

SEQ ID NO: 16212 - protein, 150 aa, Homo sapiens
  Payload ID: 3227
  Gene Symbol: C19orf43
  Gene Name: chromosome 19 open reading frame 43
  ENSP ID: ENSP00000466801
MAARGRRAEPQGREAPGPAGGGGGGSRWAESGSGTSPESGDEEVSGAGSSPVSGGVNLFANDGSFLELFKRKMEEEQRQRQEEPPPGPQRPDQSAAAAGPGDPKRKGGPGSTLSFVLTSKGDAWAKYMAEVKKYKAHQCGDDDKTRPLVK

SEQ ID NO: 16213 - protein, 133 aa, Homo sapiens
  Payload ID: 3227
  Gene Symbol: C19orf43
  Gene Name: chromosome 19 open reading frame 43
  ENSP ID: ENSP00000468415
MAARGRRAEPQGREAPGPAGGGGGGSRWAESGSGTSPESGDEEVSGAGSSPVSGGVNLFANDGSFLELFKRKMEEEQRQRQEEPPPGPQRPDQSAAAAGPGDPKRKGGPGSTLSFVGRLAELGAASGRATRPG

SEQ ID NO: 16214 - protein, 657 aa, Homo sapiens
  Payload ID: 3228
  Gene Symbol: C19orf44
  Gene Name: chromosome 19 open reading frame 44
  Uniprot ID: Q9H6X5
  ENSP ID: ENSP00000221671
MASARKASRPMRDVFGDFSDVSLEDSTMEEIRNFQISRNLTKIAPGHSRFLKRNQTLDEKHLLLKENPVLGSGPRLASCRPPTTASRIRANAALMKLAQLETRIMNRKLQRNLSDTESDSMTADAGLPKRADRILSGGALELASQNTDKTSQNQARELPVTENNAQNAKVSRFLKKKQAPVENISPEAPAGKERTLQTPKQKEPARTFDSPDSDEEEMKVLLGSLMDSSREKNTNQGFSSANVSEEEERKLFSVPSQLRAFTVPSVELSSAKPSQTSHLPTSLAADRTLHSTRSRADYPQSHVSSDTASHTPSVSITGAFSNSVSLKMGHVKLVSSPGRSEAETVDEPVSEGADDSLDEFRINILSLDGLAPAVSENSDLEQEEESAQRQKTAGKIFRAEASTGQDAPRQAQARSWASQGKAASAEGDESEVSEHLSASSASAIQQDSTSSMQPPSEAPMVNTVSSAYSEDFENSPSLTASEPTAHSKESLDRTLDALSESSSSVKTDLPQTAESRKKSGRHVTRVLVKDTAVQTPDPAFTYEWTKVASMAAMGPALGGAYVDPTPIANHVISADAIEALTAYSPAVLALHDVLKQQLSLTQQFIQASRHLHASLLRSLDADSFHYHTLEEAKEYIRCHRPAPLTMEDALEEVNKEL

SEQ ID NO: 16215 - protein, 61 aa, Homo sapiens
  Payload ID: 3228
  Gene Symbol: C19orf44
  Gene Name: chromosome 19 open reading frame 44
  ENSP ID: ENSP00000469339
MASARKASRPMRDVFGDFSDVSLEDSTMEEIRNFQISRNLTKIAPGHSRFLKRNQTLDEKH

SEQ ID NO: 16216 - protein, 35 aa, Homo sapiens
  Payload ID: 3228
  Gene Symbol: C19orf44
  Gene Name: chromosome 19 open reading frame 44
  ENSP ID: ENSP00000469749
GACPGRRLRGPDTHRQSCYQCRCNRSTLGATDLPH

SEQ ID NO: 16217 - protein, 256 aa, Homo sapiens
  Payload ID: 3228
  Gene Symbol: C19orf44
  Gene Name: chromosome 19 open reading frame 44
  ENSP ID: ENSP00000470238
MASARKASRPMRDVFGDFSDVSLEDSTMEEIRNFQISRNLTKIAPGHSRFLKRNQTLDEKHLLLKENPVLGSGPRLASCRPPTTASRIRANAALMKLAQLETRIMNRKLQRNLSDTESDSMTADAGLPKRADRILSGGALELASQNTDKTSQNQARELPVTENNAQNAKVSRFLKKKQAPVENISPEAPAGKERTLQTPKQKEPARTFDSPDSDEEEMKVLLGSLMDSSREKNTNQGFSSANVSEEEERKLFSSLE

SEQ ID NO: 16218 - protein, 93 aa, Homo sapiens
  Payload ID: 3228
  Gene Symbol: C19orf44
  Gene Name: chromosome 19 open reading frame 44
  ENSP ID: ENSP00000471623
  MOD_RES (1)..(1): Any amino acid
XPIANHVISADAIEALTAYSPAVLALHDVLKQQLSLTQQFIQASRHLHASLLRSLDADSFHYHTLEEAKEYIRCHRPAPLTMEDALEEVNKEL

SEQ ID NO: 16219 - protein, 111 aa, Homo sapiens
  Payload ID: 3228
  Gene Symbol: C19orf44
  Gene Name: chromosome 19 open reading frame 44
  ENSP ID: ENSP00000471806
MASARKASRPMRDVFGDFSDVSLEDSTMEEIRNFQISRNLTKIAPGHSRFLKRNQTLDEKHLLLKENPVLGSGPRLASCRPPTTASRIRANAALMKLAQLETRIMNRKLQR

SEQ ID NO: 16220 - protein, 618 aa, Homo sapiens
  Payload ID: 3228
  Gene Symbol: C19orf44
  Gene Name: chromosome 19 open reading frame 44
  Uniprot ID: Q9H6X5
  ENSP ID: ENSP00000472255
MASARKASRPMRDVFGDFSDVSLEDSTMEEIRNFQISRNLTKIAPGHSRFLKRNQTLDEKHLLLKENPVLGSGPRLASCRPPTTASRIRANAALMKLAQLETRIMNRKLQRNLSDTESDSMTADAGLPKRADRILSGGALELASQNTDKTSQNQARELPVTENNAQNAKVSRFLKKKQAPVENISPEAPAGKERTLQTPKQKEPARTFDSPDSDEEEMKVLLGSLMDSSREKNTNQGFSSANVSEEEERKLFSVPSQLRAFTVPSVELSSAKPSQTSHLPTSLAADRTLHSTRSRADYPQSHVSSDTASHTPSVSITGAFSNSVSLKMGHVKLVSSPGRSEAETVDEPVSEGADDSLDEFRINILSLDGLAPAVSENSDLEQEEESAQRQKTAGKIFRAEASTGQDAPRQAQARSWASQGKAASAEGDESEVSEHLSASSASAIQQDSTSSMQPPSEAPMVNTVSSAYSEDFENSPSLTASEPTAHSKESLDRTLDALSESSSSVKTDLPQTAESRKKSGRHVTRVLVKDTAVQTPDPAFTYEWTKVASMAAMGPALGGAYVDPTPIANHVISADAIEAAEPDAAVHPGQPAPARLPPALPGRGLLPLPHPGGSQRVH

SEQ ID NO: 16221 - protein, 625 aa, Homo sapiens
  Payload ID: 3228
  Gene Symbol: C19orf44
  Gene Name: chromosome 19 open reading frame 44
  ENSP ID: ENSP00000472436
MASARKASRPMRDVFGDFSDVSLEDSTMEEIRNFQISRNLTKIAPGHSRFLKRNQTLDEKHLLLKENPVLGSGPRLASCRPPTTASRIRANAALMKLAQLETRIMNRKLQRNLSDTESDSMTADAGLPKRADRILSGGALELASQNTDKTSQNQARELPVTENNAQNAKVSRFLKKKQAPVENISPEAPAGKERTLQTPKQKEPARTFDSPDSDEEEMKVLLGSLMDSSREKNTNQGFSSANVSEEEERKLFSVPSQLRAFTVPSVELSSAKPSQTSHLPTSLAADRTLHSTRSRADYPQSHVSSDTASHTPSVSITGAFSNSVSLKMGHVKLVSSPGRSEAETVDEPVSEGADDSLDEFRINILSLDGLAPAVSENSDLEQEEESAQRQKTAGKIFRAEASTGQDAPRQAQARSWASQGKAASAEGDESEVSEHLSASSASAIQQDSTSSMQPPSEAPMVNTVSSAYSEDFENSPSLTASEPTAHSKESLDRTLDALSESSSSVKTDLPQTAESRKKSGRHVTRVLVKDTAVQTPDPAFTYEWTKALTAYSPAVLALHDVLKQQLSLTQQFIQASRHLHASLLRSLDADSFHYHTLEEAKEYIRCHRPAPLTMEDALEEVNKEL

SEQ ID NO: 16222 - protein, 505 aa, Homo sapiens
  Payload ID: 3229
  Gene Symbol: C19orf45
  Gene Name: chromosome 19 open reading frame 45
  Uniprot ID: Q8NA69
  ENSP ID: ENSP00000355241
MATGALLPCSRPCPMSRLDFLKASHFSLGPDLRLHEGTMRTTSHRDFAYPAATREPPSLQPPPALLFPMDPRWDREERVSEAHRAFPPPSTPPWELLQAQARERTLAMQAGNLHLHEDAHAGIGLSNAHAAYGWPELPARTRERIRGARLIFDRDSLPPGDRDKLRIPPTTHQALFPPHDARPQPRAPSCHLGGPNTLKWDYTRQDGTSYQRQFQALPGPPALRCKRASSGVELGDCKISYGSTCSEQKQAYRPQDLPEDRYDKAQATAHIHCVNIRPGDGLFRDRTTKAEHFYAREPEPFVLHHDQTPESHILKGNWCPGPGSLDTFMQYFYGQPPPPTQPPSRHVPHEKLQSHVTLGEPKLLKRFFKTTMGSDYCPSEWRQVQKAPNLHLQQSYLPRGTGEFDFLTMNQKMLKPHRTPPAPVTEEMLQRCKYSHMEPPLGGLRFFSTQYKDEFPFKYQGPAALRLKNPQEGFVPLGTPHQRGCREKIDPLVPQPPMYLCPSQQ

SEQ ID NO: 16223 - protein, 192 aa, Homo sapiens
  Payload ID: 3229
  Gene Symbol: C19orf45
  Gene Name: chromosome 19 open reading frame 45
  ENSP ID: ENSP00000469556
MATGALLPCSRPCPMSRLDFLKASHFSLGPDLRLHEGTMRTTSHRDFAYPAATREPPSLQPPPALLFPMDPRWDREERVSEAHRAFPPPSTPPWELLQAQARERTLAMQAGNLHLHEDAHAGIGLSNAHAAYGWPELPARTRERIRGARLIFDRDSLPPGDRDKLRIPPTTHQALFPPHDARPQPRAPSCHL

SEQ ID NO: 16224 - protein, 223 aa, Homo sapiens
  Payload ID: 3229
  Gene Symbol: C19orf45
  Gene Name: chromosome 19 open reading frame 45
  ENSP ID: ENSP00000469882
MATGALLPCSRPCPMSRLDFLKASHFSLGPDLRLHEGTMRTTSHRDFAYPAATREPPSLQPPPALLFPMDPRWDREERVSEAHRAFPPPSTPPWELLQAQARERTLAMQAGNLHLHEDAHAGIGLSNAHAAYGWPELPARTRERIRGARLIFDRDSLPPGDRDKLRIPPTTHQALFPPHDARPQPRAPSCHLGGPNTLKWDYTRQDGTSYQRQFQALPGPPAL

SEQ ID NO: 16225 - protein, 180 aa, Homo sapiens
  Payload ID: 3229
  Gene Symbol: C19orf45
  Gene Name: chromosome 19 open reading frame 45
  ENSP ID: ENSP00000471093
MATGALLPCSRPCPMSRLDFLKASHFSLGPDLRLHEGTMRTTSHRDFAYPAATREPPSLQPPPALLFPMDPRWDREERVSEAHRAFPPPSTPPWELLQAQARERTLAMQAGNLHLHEDAHAGIGLSNAHAAYGWPELPARTRERIRGARLIFDRDSLPPGDRDKLRIPPTTHQALFPPHD

SEQ ID NO: 16226 - protein, 90 aa, Homo sapiens
  Payload ID: 3229
  Gene Symbol: C19orf45
  Gene Name: chromosome 19 open reading frame 45
  ENSP ID: ENSP00000471316
IFDRDSLPPGDRDKLRIPPTTHQALFPPHDARPQPRAPSCHLGGPNTLKWDYTRQDGTSYQRQFQALPGPPALRCKRDHQGRALLCQGAR

SEQ ID NO: 16227 - protein, 146 aa, Homo sapiens
  Payload ID: 3230
  Gene Symbol: C19orf47
  Gene Name: chromosome 19 open reading frame 47
  ENSP ID: ENSP00000350556
  MOD_RES (1)..(1): Any amino acid
XGSSVRARETMVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSDGVSLCCPGWSTVARPWLSATSASRVQAVLLPQPPE

SEQ ID NO: 16228 - protein, 355 aa, Homo sapiens
  Payload ID: 3230
  Gene Symbol: C19orf47
  Gene Name: chromosome 19 open reading frame 47
  Uniprot ID: Q8N9M1
  ENSP ID: ENSP00000375889
MFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSKSSAEVKVTIKRTLVGPRGSSSSEGLGAQMDHAGTVSVFKRLGRRTF

SEQ ID NO: 16229 - protein, 422 aa, Homo sapiens
  Payload ID: 3230
  Gene Symbol: C19orf47
  Gene Name: chromosome 19 open reading frame 47
  Uniprot ID: Q8N9M1
  ENSP ID: ENSP00000463159
MVMAALSLVAACWGRAAADESVQLPAAPGSSVRARETMVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSKSSAEVKVTIKRTLVGPRGSSSSEGLGAQMDHAGTVSVFKRLGRRTF

SEQ ID NO: 16230 - protein, 141 aa, Homo sapiens
  Payload ID: 3230
  Gene Symbol: C19orf47
  Gene Name: chromosome 19 open reading frame 47
  ENSP ID: ENSP00000463294
MVMAALSLVAACWGRAAADESVQLPAAPGSSVRARETMVSVTMATSEWIQFFKEAGIPPGPAVNYAVMFVDNRIQKSMLLDLNKEIMNELGVTVVGDIIAILKHAKVVHRQGLTPSPRLECSSTISAHCNLCLPGHVQSCH

SEQ ID NO: 16231 - protein, 142 aa, Homo sapiens
  Payload ID: 3230
  Gene Symbol: C19orf47
  Gene Name: chromosome 19 open reading frame 47
  ENSP ID: ENSP00000463305
MFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEG

SEQ ID NO: 16232 - protein, 146 aa, Homo sapiens
  Payload ID: 3230
  Gene Symbol: C19orf47
  Gene Name: chromosome 19 open reading frame 47
  ENSP ID: ENSP00000464478
MVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKAT

SEQ ID NO: 16233 - protein, 168 aa, Homo sapiens
  Payload ID: 3230
  Gene Symbol: C19orf47
  Gene Name: chromosome 19 open reading frame 47
  ENSP ID: ENSP00000464567
  MOD_RES (1)..(1): Any amino acid
XEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQASA

SEQ ID NO: 16234 - protein, 117 aa, Homo sapiens
  Payload ID: 3231
  Gene Symbol: C19orf48
  Gene Name: chromosome 19 open reading frame 48
  Uniprot ID: Q6RUI8
  ENSP ID: ENSP00000301419
MTVLEAVLEIQAITGSRLLSMVPGPARPPGSCWDPTQCTRTWLLSHTPRRRWISGLPRASCRLGEEPPPLPYCDQAYGEELSIRHRETWAWLSRTDTAWPGAPGVKQARILGELLLV

SEQ ID NO: 16235 - protein, 117 aa, Homo sapiens; identical to SEQ ID NO: 16234
  Payload ID: 3231
  Gene Symbol: C19orf48
  Gene Name: chromosome 19 open reading frame 48
  Uniprot ID: Q6RUI8
  ENSP ID: ENSP00000375688

SEQ ID NO: 16236 - protein, 25 aa, Homo sapiens
  Payload ID: 3231
  Gene Symbol: C19orf48
  Gene Name: chromosome 19 open reading frame 48
  ENSP ID: ENSP00000469238
MTVLEAVLEIQAITGSRLLSMVPGP

SEQ ID NO: 16237 - protein, 12 aa, Homo sapiens
  Payload ID: 3231
  Gene Symbol: C19orf48
  Gene Name: chromosome 19 open reading frame 48
  ENSP ID: ENSP00000470222
MLGPNPVHKDLA

SEQ ID NO: 16238 - protein, 48 aa, Homo sapiens
  Payload ID: 3231
  Gene Symbol: C19orf48
  Gene Name: chromosome 19 open reading frame 48
  ENSP ID: ENSP00000470455
MTVLEAVLEIQAITGSRLLSMVPGPARPPGSCWDPTQCTRTWLLSHTP

SEQ ID NO: 16239 - protein, 117 aa, Homo sapiens; identical to SEQ ID NO: 16234
  Payload ID: 3231
  Gene Symbol: C19orf48
  Gene Name: chromosome 19 open reading frame 48
  Uniprot ID: Q6RUI8
  ENSP ID: ENSP00000471005

SEQ ID NO: 16240 - protein, 117 aa, Homo sapiens; identical to SEQ ID NO: 16234
  Payload ID: 3231
  Gene Symbol: C19orf48
  Gene Name: chromosome 19 open reading frame 48
  Uniprot ID: Q6RUI8
  ENSP ID: ENSP00000471463

SEQ ID NO: 16241 - protein, 38 aa, Homo sapiens
  Payload ID: 3231
  Gene Symbol: C19orf48
  Gene Name: chromosome 19 open reading frame 48
  ENSP ID: ENSP00000471910
MTVLEAVLEIQAITGSRLLSMVPGPARPPGSCWDPTQC

SEQ ID NO: 16242 - protein, 82 aa, Homo sapiens
  Payload ID: 3231
  Gene Symbol: C19orf48
  Gene Name: chromosome 19 open reading frame 48
  ENSP ID: ENSP00000472200
MTVLEAVLEIQAITGSRLLSMVPGPARPPGSCWDPTQCTRTWLLSHTPRRRWISGLPRASCRLGEEPPPLPYCDQAYGEELS

SEQ ID NO: 16243 - protein, 81 aa, Homo sapiens
  Payload ID: 3231
  Gene Symbol: C19orf48
  Gene Name: chromosome 19 open reading frame 48
  ENSP ID: ENSP00000473143
MTVLEAVLEIQAITGSRLLSMVPGPARPPGSCWDPTQCTRTWLLSHTPRRRWISGLPRASCRLGEEPPPLPYCDQAYGEEL

SEQ ID NO: 16244 - protein, 260 aa, Homo sapiens
  Payload ID: 3232
  Gene Symbol: C19orf52
  Gene Name: chromosome 19 open reading frame 52
  Uniprot ID: Q9BSF4
  ENSP ID: ENSP00000270502
MAAAALRRFWSRRRAEAGDAVVAKPGVWARLGSWARALLRDYAEACRDASAEARARPGRAAVYVGLLGGAAACFTLAPSEGAFEEALLEASGTLLLLAPATRNRESEAFVQRLLWLRGRGRLRYVNLGLCSLVYEAPFDAQASLYQARCRYLQPRWTDFPGRVLDVGFVGRWWVLGAWMRDCDINDDEFLHLPAHLRVVGPQQLHSETNERLFDEKYKPVVLTDDQVDQALWEEQVLQKEKKDRLALSQAHSLVQAEAPR

SEQ ID NO: 16245 - protein, 27 aa, Homo sapiens
  Payload ID: 3232
  Gene Symbol: C19orf52
  Gene Name: chromosome 19 open reading frame 52
  ENSP ID: ENSP00000466926
  MOD_RES (1)..(1): Any amino acid
XQVLQKEKKDRLALSQAHSLVQAEAPR

SEQ ID NO: 16246 - protein, 80 aa, Homo sapiens
  Payload ID: 3233
  Gene Symbol: C19orf53
  Gene Name: chromosome 19 open reading frame 53
  ENSP ID: ENSP00000221576
WRRGSASFRRTNPQRVRRQRQPLKRIGAQEKANLEVGIRKKIEHDVVMKASSSLPKKLALLKAPAKKKGAAAATSSKTPS

SEQ ID NO: 16247 - protein, 5 aa, Homo sapiens
  Payload ID: 3233
  Gene Symbol: C19orf53
  Gene Name: chromosome 19 open reading frame 53
  ENSP ID: ENSP00000464785
PKKRR

SEQ ID NO: 16248 - protein, 31 aa, Homo sapiens
  Payload ID: 3233
  Gene Symbol: C19orf53
  Gene Name: chromosome 19 open reading frame 53
  ENSP ID: ENSP00000464891
  MOD_RES (1)..(1): Any amino acid
XKGGRVIAPKKARVVQQQKLKKVSLCCSGWS

SEQ ID NO: 16249 - protein, 99 aa, Homo sapiens
  Payload ID: 3233
  Gene Symbol: C19orf53
  Gene Name: chromosome 19 open reading frame 53
  Uniprot ID: Q9UNZ5
  ENSP ID: ENSP00000465432
MAQGQRKFQAHKPAKSKTAAAASEKNRGPRKGGRVIAPKKARVVQQQKLKKNLEVGIRKKIEHDVVMKASSSLPKKLALLKAPAKKKGAAAATSSKTPS

SEQ ID NO: 16250 - protein, 49 aa, Homo sapiens
  Payload ID: 3233
  Gene Symbol: C19orf53
  Gene Name: chromosome 19 open reading frame 53
  ENSP ID: ENSP00000466736
  MOD_RES (1)..(1): Any amino acid
XKSKTAAAASEKNRGPRKGGRVIAPKKARVVQQQKLKKRQVSLCCSGWS

SEQ ID NO: 16251 - protein, 56 aa, Homo sapiens
  Payload ID: 3233
  Gene Symbol: C19orf53
  Gene Name: chromosome 19 open reading frame 53
  ENSP ID: ENSP00000468676
MEPGAQRGNLEVGIRKKIEHDVVMKASSSLPKKLALLKAPAKKKGAAAATSSKTPS

SEQ ID NO: 16252 - protein, 351 aa, Homo sapiens
  Payload ID: 3234
  Gene Symbol: C19orf54
  Gene Name: chromosome 19 open reading frame 54
  Uniprot ID: Q5BKX5
  ENSP ID: ENSP00000367564
MTSPCSPPLKPPISPPKTPVPQASSIPSPPLPPSPLDFSALPSPPWSQQTPVPPPLPLPPPPAATGPAPRHVFGLEKSQLLKEAFDKAGPVPKGREDVKRLLKLHKDRFRGDLRWILFCADLPSLIQEGPQCGLVALWMAGTLLSPPSGVPLERLIRVATERGYTAQGEMFSVADMGRLAQEVLGCQAKLLSGGLGGPNRDLVLQHLVTGHPLLIPYDEDFNHEPCQRKGHKAHWAVSAGVLLGVRAVPSLGYTEDPELPGLFHPVLGTPCQPPSLPEEGSPGAVYLLSKQGKSWHYQLWDYDQVRESNLQLTDFSPSRATDGRVYVVPVGGVRAGLCGQALLLTPQDCSH

SEQ ID NO: 16253 - protein, 67 aa, Homo sapiens
  Payload ID: 3234
  Gene Symbol: C19orf54
  Gene Name: chromosome 19 open reading frame 54
  ENSP ID: ENSP00000469330
MRAGGLVDGRYSPVAPQWRPPGETHTGGHGKRLHGPGRDVLSTSYDEDFNHEPCQRKGHKAHWAAQE

SEQ ID NO: 16254 - protein, 57 aa, Homo sapiens
  Payload ID: 3234
  Gene Symbol: C19orf54
  Gene Name: chromosome 19 open reading frame 54
  ENSP ID: ENSP00000469807
MAGTLLSPPSGVPLERLIRVATERGYTAQGEMFSAPATTRTSTMSRVRGRATRHTGR

SEQ ID NO: 16255 - protein, 57 aa, Homo sapiens; identical to SEQ ID NO: 16254
  Payload ID: 3234
  Gene Symbol: C19orf54
  Gene Name: chromosome 19 open reading frame 54
  ENSP ID: ENSP00000471114

SEQ ID NO: 16256 - protein, 170 aa, Homo sapiens
  Payload ID: 3234
  Gene Symbol: C19orf54
  Gene Name: chromosome 19 open reading frame 54
  ENSP ID: ENSP00000471589
MAGTLLSPPSGVPLERLIRVATERGYTAQGEMFSVADMGRLAQEVLGCQAKLLSGGLGGPNRDLVLQHLVTGHPLLIPYDEDFNHEPCQRKGHKAHWAGSCWVFGLCPVSATLRTLSCRACSTQCWARPANHHPCQRRAPRELSTCCPSRARVGTISCGTTTRSGRATCS

SEQ ID NO: 16257 - protein, 57 aa, Homo sapiens; identical to SEQ ID NO: 16254
  Payload ID: 3234
  Gene Symbol: C19orf54
  Gene Name: chromosome 19 open reading frame 54
  ENSP ID: ENSP00000472022

SEQ ID NO: 16258 - protein, 112 aa, Homo sapiens
  Payload ID: 3234
  Gene Symbol: C19orf54
  Gene Name: chromosome 19 open reading frame 54
  ENSP ID: ENSP00000472820
  MOD_RES (1)..(1): Any amino acid
XFDKAGPVPKGREDVKRLLKLHKDRFRGDLRWILFCADLPSLIQEGPQCGLVALWMAGTLLSPPSGVPLERLIRVATERGYTAQGEMFSAPATTRTSTMSRVRGRATRHTGR

SEQ ID NO: 16259 - protein, 65 aa, Homo sapiens
  Payload ID: 3234
  Gene Symbol: C19orf54
  Gene Name: chromosome 19 open reading frame 54
  ENSP ID: ENSP00000472948
  MOD_RES (1)..(1): Any amino acid
XHVFGLEKSQLLKEAFDKAGPVPKGREDVKRLLKLHKDRFRGDLRWILFCADLPSLIQEGPQYVP

SEQ ID NO: 16260 - protein, 182 aa, Homo sapiens
  Payload ID: 3234
  Gene Symbol: C19orf54
  Gene Name: chromosome 19 open reading frame 54
  ENSP ID: ENSP00000473024
PAPRHVFGLEKSQLLKEAFDKAGPVPKGREDVKRLLKLHKDRFRGDLRWILFCADLPSLIQEGPQCGLVALWMAGTLLSPPSGVPLERLIRVATERGYTAQGEMFSAPATTRTSTMSRVRGRATRHTGRGRLCHLTRHLRNLLPGPSASHRTGTLNCVSLSSPLLSPSFKAHLGAVTCASPS

SEQ ID NO: 16261 - protein, 637 aa, Homo sapiens
  Payload ID: 3235
  Gene Symbol: C19orf57
  Gene Name: chromosome 19 open reading frame 57
  Uniprot ID: Q0VDD7
  ENSP ID: ENSP00000254336
MTKRKKLRTSGEGLCPPKPLKNPRLGDFYGDPQSSMLGCLHHPEEPEGKLGPVPSTQQHGEEPGKAVSSSPDEETGSPCRLLRQPEKEPAPLPPSQNSFGRFVPQFAKSRKTVTRKEEMKDEDRGSGAFSLETIAESSAQSPGCQLLVETLGVPLQEATELGDPTQADSARPEQSSQSPVQAVPGSGDSQPDDPPDRGTGLSASQRASQDHLSEQGADDSKPETDRVPGDGGQKEHLPSIDSEGEKPDRGAPQEGGAQRTAGAGLPGGPQEEGDGVPCTPASAPTSGPAPGLGPASWCLEPGSVAQGSPDPQQTPSRMGREGEGTHSSLGCSSLGMVVIADLSTDPTELEERALEVAGPDGQASAISPASPRRKAADGGHRRALPGCTSLTGETTGESGEAGQDGKPPGDVLVGPTASLALAPGSGESMMGAGDSGHASPDTGPCVNQKQEPGPAQEEAELGGQNLERDLEGFRVSPQASVVLEHREIADDPLQEPGAQQGIPDTTSELAGQRDHLPHSADQGTWADSLAVELDFLLDSQIQDALDASDFEAPPEQLFPSGNKPGPCWPGPSSHANGDPVAVAKAQPSRLIMGTHRDLEAFKRLNYRKTKLGGKAPLPYPSKGPGNIPRGDPPWREL

SEQ ID NO: 16262 - protein, 295 aa, Homo sapiens
  Payload ID: 3235
  Gene Symbol: C19orf57
  Gene Name: chromosome 19 open reading frame 57
  ENSP ID: ENSP00000464829
  MOD_RES (1)..(1): Any amino acid
XQGSPDPQQTPSRMGREGEGTHSSLGCSSLGMVVIADLSTDPTELEERALEVAGPDGQASAISPASPRRKAADGGHRRALPGCTSLTGETTGESGEAGQDGKPPGDVLVGPTASLALAPGSGESMMGAGDSGHASPDTGPCVNQKQEPGPAQEEAELGGQNLERDLEGFRVSPQASVVLEHREIADDPLQEPGAQQGIPDTTSELAGQRDHLPHSADQGTWADSLAVELDFLLDSQIQDALDASDFEAPPEQLFPSGNKPGPCWPGPSSHANGDPVAVAKAQPRPPVSRPPACCV

SEQ ID NO: 16263 - protein, 668 aa, Homo sapiens
  Payload ID: 3235
  Gene Symbol: C19orf57
  Gene Name: chromosome 19 open reading frame 57
  Uniprot ID: Q0VDD7
  ENSP ID: ENSP00000465822
MTKRKKLRTSGEGLCPPKPLKNPRLGDFYGDPQSSMLGCLHHPEEPEGKLGPVPSTQQHGEEPGKAVSSSPDEETGSPCRLLRQPEKEPAPLPPSQNSFGRFVPQFAKSRKTVTRKEEMKDEDRGSGAFSLETIAESSAQSPGCQLLVETLGVPLQEATELGDPTQADSARPEQSSQSPVQAVPGSGDSQPDDPPDRGTGLSASQRASQDHLSEQGADDSKPETDRVPGDGGQKEHLPSIDSEGEKPDRGAPQEGGAQRTAGAGLPGGPQEEGDGVPCTPASAPTSGPAPGLGPASWCLEPGSVAQGSPDPQQTPSRMGREGEGTHSSLGCSSLGMVVIADLSTDPTELEERALEVAGPDGQASAISPASPRRKAADGGHRRALPGCTSLTGETTGESGEAGQDGKPPGDVLVGPTASLALAPGSGESMMGAGDSGHASPDTGPCVNQKQEPGPAQEEAELGGQNLERDLEGFRVSPQASVVLEHREIADDPLQEPGAQQGIPDTTSELAGQRDHLPHSADQGTWADSLAVELDFLLDSQIQDALDASDFEAPPEQLFPSGNKPGPCWPGPSSHANGDPVAVAKAQPRTFVGIQASEASRMEDATNVVRGLIVELSNLNRLIMGTHRDLEAFKRLNYRKTKLGGKAPLPYPSKGPGNIPRGDPPWREL

SEQ ID NO: 16264 - protein, 25 aa, Homo sapiens
  Payload ID: 3235
  Gene Symbol: C19orf57
  Gene Name: chromosome 19 open reading frame 57
  ENSP ID: ENSP00000466119
MTKRKKLRTSAPLMRKQDLPAGSSV

SEQ ID NO: 16265 - protein, 243 aa, Homo sapiens
  Payload ID: 3235
  Gene Symbol: C19orf57
  Gene Name: chromosome 19 open reading frame 57
  ENSP ID: ENSP00000466723
MTKRKKLRTSGEGLCPPKPLKNPRLGDFYGDPQSSMLGCLHHPEEPEGKLGPVPSTQQHGEEPGKAVSSSPDEETGSPCRLLRQPEKEPAPLPPSQNSFGRFVPQFAKSRKTVTRKEEMKDEDRGSGAFSLLFPSGNKPGPCWPGPSSHANGDPVAVAKAQPRTFVGIQASEASRMEDATNVVRGLIVELSNLNRLIMGTHRDLEAFKRLNYRKTKLGGKAPLPYPSKGPGNIPRGDPPWREL

SEQ ID NO: 16266 - protein, 87 aa, Homo sapiens
  Payload ID: 3235
  Gene Symbol: C19orf57
  Gene Name: chromosome 19 open reading frame 57
  ENSP ID: ENSP00000467241
FVRLLELFPSGNKPGPCWPGPSSHANGDPVAVAKAQPSRLIMGTHRDLEAFKRLNYRKTKLGGKAPLPYPSKGPGNIPRGDPPWREL

SEQ ID NO: 16267 - protein, 139 aa, Homo sapiens
  Payload ID: 3235
  Gene Symbol: C19orf57
  Gene Name: chromosome 19 open reading frame 57
  ENSP ID: ENSP00000468467
RVSPQASVVLEHREIADDPLQEPGAQQGIPDTTSELAGQRDHLPHSADQGTWADSLAVELDFLLDSQIQDALDASDFEAPPEQLFPSGNKPGPCWPGPSSHANGDPVAVAKAQPRGRLCPCLLPSLPVTCTCCATGHLP

SEQ ID NO: 16268 - protein, 201 aa, Homo sapiens
  Payload ID: 3236
  Gene Symbol: C19orf60
  Gene Name: chromosome 19 open reading frame 60
  Uniprot ID: Q96EN9
  ENSP ID: ENSP00000351422
MITETAAEPTVPAVPAAEEATEARGREEPAWPWKDAPIRTLVQRIHQLQAERAQGFRRLEEWLAPVQGLRAWGRGLRVPTCRRGHRQYLRSGPDYDFARYRSTVHGVTQAFAAASREVLAVEAELGGPRRQPLLAGHVRSLQELEQTRLGTVALLQLMETPELAGQEDAVRMQQLKMKVIKTMEAISEVLQDLRFDAESAE

SEQ ID NO: 16269 - protein, 179 aa, Homo sapiens
  Payload ID: 3236
  Gene Symbol: C19orf60
  Gene Name: chromosome 19 open reading frame 60
  Uniprot ID: Q96EN9
  ENSP ID: ENSP00000398467
MITETAAEPTVPAVPAAEEATEARGREEPAWPWKDAPIRTLVQRIHQLQAERAQGFRRLEEGHRQYLRSGPDYDFARYRSTVHGVTQAFAAASREVLAVEAELGGPRRQPLLAGHVRSLQELEQTRLGTVALLQLMETPELAGQEDAVRMQQLKMKVIKTMEAISEVLQDLRFDAESAE

SEQ ID NO: 16270 - protein, 60 aa, Homo sapiens
  Payload ID: 3236
  Gene Symbol: C19orf60
  Gene Name: chromosome 19 open reading frame 60
  ENSP ID: ENSP00000469859
  MOD_RES (1)..(1): Any amino acid
XLGGPRRQPLLAGHVRSLQELEQTRLGTVALLQLMETPELAGQEDAVRMQQLKMNSHPLL

SEQ ID NO: 16271 - protein, 66 aa, Homo sapiens
  Payload ID: 3236
  Gene Symbol: C19orf60
  Gene Name: chromosome 19 open reading frame 60
  ENSP ID: ENSP00000471429
MITETAAEPTVPAVPAAEEATEARGREEPAWPWKDAPIRTLVQRIHQLQAERAQGFRRLEEWPCCS

SEQ ID NO: 16272 - protein, 291 aa, Homo sapiens
  Payload ID: 3237
  Gene Symbol: C19orf66
  Gene Name: chromosome 19 open reading frame 66
  Uniprot ID: Q9NUL5
  ENSP ID: ENSP00000253110
MSQEGVELEKSVRRLREKFHGKVSSKKAGALMRKFGSDHTGVGRSIVYGVKQKDGQELSNDLDAQDPPEDMKQDRDIQAVATSLLPLTEANLRMFQRAQDDLIPAVDRQFACSSCDHVWWRRVPQRKEVSRCRKCRKRYEPVPADKMWGLAEFHCPKCRHNFRGWAQMGSPSPCYGCGFPVYPTRILPPRWDRDPDRRSTHTHSCSAADCYNRREPHVPGTSCAHPKSRKQNHLPKVLHPSNPHISSGSTVATCLSQGGLLEDLDNLILEDLKEEEEEEEEVEDEEGGPRE

SEQ ID NO: 16273 - protein, 240 aa, Homo sapiens
  Payload ID: 3237
  Gene Symbol: C19orf66
  Gene Name: chromosome 19 open reading frame 66
  Uniprot ID: Q9NUL5
  ENSP ID: ENSP00000380978
MSQHQQACGICRQEDPPEDMKQDRDIQAVATSLLPLTEANLRMFQRAQDDLIPAVDRQFACSSCDHVWWRRVPQRKEVSRCRKCRKRYEPVPADKMWGLAEFHCPKCRHNFRGWAQMGSPSPCYGCGFPVYPTRILPPRWDRDPDRRSTHTHSCSAADCYNRREPHVPGTSCAHPKSRKQNHLPKVLHPSNPHISSGSTVATCLSQGGLLEDLDNLILEDLKEEEEEEEEVEDEEGGPRE

SEQ ID NO: 16274 - protein, 77 aa, Homo sapiens
  Payload ID: 3237
  Gene Symbol: C19orf66
  Gene Name: chromosome 19 open reading frame 66
  ENSP ID: ENSP00000466217
  MOD_RES (1)..(1): Any amino acid
XVYGVKQKDGQELSNDLDAQTKKLRPKSLASKQGQLRFEPWPPGVRAWALTCLRAQRGLKGAICHNINKHVAFAGRK

SEQ ID NO: 16275 - protein, 71 aa, Homo sapiens
  Payload ID: 3237
  Gene Symbol: C19orf66
  Gene Name: chromosome 19 open reading frame 66
  ENSP ID: ENSP00000466550
MPPSTTWPQRGDMSQHQQACGICRQEDPPEDMKQDRDIQAVATSLLPLTEANLRMFQRAQDDLIPAVDRQF

SEQ ID NO: 16276 - protein, 127 aa, Homo sapiens
  Payload ID: 3237
  Gene Symbol: C19orf66
  Gene Name: chromosome 19 open reading frame 66
  ENSP ID: ENSP00000466633
MSQEGVELEKSVRRLREKFHGKVSSKKAGALMRKFGSDHTGVGRSIVYGVKQKDGQELSNDLDAQTKKLRPKSLASKQGQLRFEPWPPGVRAWALTCLRAQRGLKGAICHNINKHVAFAGRKIHQKI

SEQ ID NO: 16277 - protein, 143 aa, Homo sapiens
  Payload ID: 3237
  Gene Symbol: C19orf66
  Gene Name: chromosome 19 open reading frame 66
  ENSP ID: ENSP00000467167
DPPEDMKQDRDIQKPTYACFNVPRTTLSLLWTGSLPAPPATTSGGAACPSGRRYPGAGNAGSATSQCQLTRCGAWLSSTARSVGTTSAPTLTPAQLPTATTGESPTCLGHPVLTPRAGSRTTCPKCSTPATLTLAVAPLWPPA

SEQ ID NO: 16278 - protein, 255 aa, Homo sapiens
  Payload ID: 3237
  Gene Symbol: C19orf66
  Gene Name: chromosome 19 open reading frame 66
  Uniprot ID: Q9NUL5
  ENSP ID: ENSP00000467182
MSQEGVELEKSVRRLREKFHGKVSSKKAGALMRKFGSDHTGVGRSIVYGVKQKDGQELSNDLDAQDPPEDMKQDRDIQAVATSLLPLTEANLRMFQRAQDDLIPAVDRQFACSSCDHVWWRRVPQRKEVSRCRKCRKRYEPVPADKMWGLAEFHCPKCRHNFRTHTHSCSAADCYNRREPHVPGTSCAHPKSRKQNHLPKVLHPSNPHISSGSTVATCLSQGGLLEDLDNLILEDLKEEEEEEEEVEDEEGGPRE

SEQ ID NO: 16279 - protein, 216 aa, Homo sapiens
  Payload ID: 3238
  Gene Symbol: C19orf67
  Gene Name: chromosome 19 open reading frame 67
  ENSP ID: ENSP00000340842
MPTFLQMCEPYFLYLEAAARSIPPIYGPLQELVRKGLLEISQQLTLRLEQLVLMYASFGFVDLEEMNPLSISCFFCGRFSISLSHEVSIFRYCAPTAYTASRFPRYLYKKMRWHLEATPEAPGRGQDSLVDYYFLCYRDTWEDTGQSPANSCPQIQKLWSIGRWVPLGPAEDDLYSWILCPQPLGDYQQLLTIGFEEPTPTLATDLLVQILTGQAG

SEQ ID NO: 16280 - protein, 358 aa, Homo sapiens
  Payload ID: 3238
  Gene Symbol: C19orf67
  Gene Name: chromosome 19 open reading frame 67
  Uniprot ID: A6NJJ6
  ENSP ID: ENSP00000449137
MATEQWFEGSLPLDPGETPPPDALEPGTPPCGDPSRSTPPGRPGNPSEPDPEDAEGRLAEARASTSSPKPLVPRPGPAPPRLSLDTLFSPITQQLRYLLKKADDFQSYLLYSRDQVQKEQLAKAMPTFLQMCEPYFLYLEAAARSIPPIYGPLQELVRKGLLEISQQLTLRLEQLVLMYASFGFVDLEEMNPLSISCFFCGRFSISLSHEVSIFRYCAPTAYTASRFPRYLYKKMRWHLEATPEAPGRGQDSLVDYYFLCYRDTWEDTGQSPANSCPQIQKLWSIGRWVPLGPAEDDLYSWILCPQPLGDYQQLLTIGFEEPTPTLATDLLVQILTGQAGQARPPSAAGPAGWAAQGS

SEQ ID NO: 16281 - protein, 627 aa, Homo sapiens
  Payload ID: 3239
  Gene Symbol: C19orf68
  Gene Name: chromosome 19 open reading frame 68
  Uniprot ID: Q86XI8
  ENSP ID: ENSP00000331363
MERPEPPPGTAAGQEEQELRERAFFSWAEFSRFFDAWCQQRLALFFVKSSMHLARCRWASAPPLYTLIDVLKYSYVRLVCKDVRAPSRPAVGPPQPGCPAFIIVKLSPLRDRLVVTECQLTHSHPACPLEFAYYFRPGHLLANACLPVRTTNKISKQFVAPADVRRLLSYCKGRDHGVLDALHVLEGLFRTDPEAKVKLVFVEDQAVVETVFFLTSRTRALLRRFPRMLLVDRLPGLQGALDLLAVLCVDGSGRARQAACCVARPGTPSLLRFALASLLQSAPDVKGRVRCLTAGPEVAAQLPAVRQLLPCARVQICRAQGLETLFSKAQELGGAGREDPGLWSRLCRLAGASSPAAYDEALAELHAHGPAAFVDYFERNWEPRRDMWVRFRAFEAARDLDACALVRGHRRRLLRRLSPSRGVAQCLRDLVAMQWADAAGEAVPEGPDGGGPWLEDEPGRGAQGENERVRGLETGDWGGAPKEGSIWRGAQMEKEWARALETRDWGGAQFEGEKGRALQIRDWRGGRLENQKPRGLEGGVLRGSKLEKGHLRGPEIRDWRGPQLEGEKDWGLEGYVWRGSQLEDQALRGLEGYTWRVAQLEDRRSTTDLRGTQFDYERGKGESTEDR

SEQ ID NO: 16282 - protein, 920 aa, Homo sapiens
  Payload ID: 3239
  Gene Symbol: C19orf68
  Gene Name: chromosome 19 open reading frame 68
  ENSP ID: ENSP00000480314
MERPEPPPGTAAGQEEQELRERAFFSWAEFSRFFDAWCQQRLALFFVKSSMHLARCRWASAPPLYTLIDVLKYSYVRLVCKDVRAPSRPAVGPPQPGCPAFIIVKLSPLRDRLVVTECQLTHSHPACPLEFAYYFRPGHLLANACLPVRTTNKISKQFVAPADVRRLLSYCKGRDHGVLDALHVLEGLFRTDPEAKVKLVFVEDQAVVETVFFLTSRTRALLRRFPRMLLVDRLPGLQGALDLLAVLCVDGSGRARQAACCVARPGTPSLLRFALASLLQSAPDVKGRVRCLTAGPEVAAQLPAVRQLLPCARVQICRAQGLETLFSKAQELGGAGREDPGLWSRLCRLAGASSPAAYDEALAELHAHGPAAFVDYFERNWEPRRDMWVRFRAFEAARDLDACALVRGHRRRLLRRLSPSRGVAQCLRDLVAMQWADAAGEAVPEGPDGGGPWLEDEPGRGAQGENERVRGLETGDWGGAPKEGSIWRGAQMEKEWARALETRDWGGAQFEGEKGRALQIRDWRGGRLENQKPRGLEGGVLRGSKLEKGHLRGPEIRDWRGPQLEGEKDWGLEGYVWRGSQLEDQALRGLEGYTWRVAQLEDRRSTTDLRGTQFDYERVRSLEGSPWRGAQLHDERAGGLRTAEWKGPQSEVEKGRGLEVRNLRGIPLEKSLELAPENGDQRGPQWEDERRRGPEIAEERGARVGVKRRRGLEDIVLVQLGDTRVTGMENGDGGGARSVGPKSRAGRGMEWGDAGGRCLGLGNGVVSGTPVGTVLEGSPEWAAARSEHLAAGDGLQEGGEDGPREPKRLCRPPGEEEVDWEPLAKFRAACGPELADLVAEELAFARQHGTRGFHWTGAGFALKDGTSDFFLDGALTRCSCSIHAARRLPCRHLFAARLLTGAALFHMDLLRDCWGRAPEP

SEQ ID NO: 16283 - protein, 118 aa, Homo sapiens
  Payload ID: 3240
  Gene Symbol: C19orf70
  Gene Name: chromosome 19 open reading frame 70
  Uniprot ID: Q5XKP0
  ENSP ID: ENSP00000309561
MVARVWSLMRFLIKGSVAGGAVYLVYDQELLGPSDKSQAALQKAGEVVPPAMYQFSQYVCQQTGLQIPQLPAPPKIYFPIRDSWNAGIMTVMSALSVAPSKAREYSKEGWEYVKARTK

SEQ ID NO: 16284 - protein, 88 aa, Homo sapiens
  Payload ID: 3240
  Gene Symbol: C19orf70
  Gene Name: chromosome 19 open reading frame 70
  ENSP ID: ENSP00000464857
MVARVWSLMRFLIKGSVAGGAVYLVYDQELLGPSDKSQAALQKAGEVVPPAMYQFSQYVCQQTGLQIPQLPAPPKIYFPIRDSWNAGI

SEQ ID NO: 16285 - protein, 110 aa, Homo sapiens
  Payload ID: 3240
  Gene Symbol: C19orf70
  Gene Name: chromosome 19 open reading frame 70
  ENSP ID: ENSP00000465739
MRSECVLGAASDSGQEAPRDTWFLQGWKASRRFLIKGSVAGGAVYLVYDQELLGPSDKSQAALQKAGEVVPPAMYQFSQYVCQQTGLQIPQLPAPPKIYFPIRDSWNAGI

SEQ ID NO: 16286 - protein, 140 aa, Homo sapiens
  Payload ID: 3240
  Gene Symbol: C19orf70
  Gene Name: chromosome 19 open reading frame 70
  ENSP ID: ENSP00000468723
MRSECVLGAASDSGQEAPRDTWFLQGWKASRRFLIKGSVAGGAVYLVYDQELLGPSDKSQAALQKAGEVVPPAMYQFSQYVCQQTGLQIPQLPAPPKIYFPIRDSWNAGIMTVMSALSVAPSKAREYSKEGWEYVKARTK

SEQ ID NO: 16287 - protein, 209 aa, Homo sapiens
  Payload ID: 3241
  Gene Symbol: C19orf71
  Gene Name: chromosome 19 open reading frame 71
  Uniprot ID: A6NCJ1
  ENSP ID: ENSP00000327950
MQTLRQEAARPCIPSGTLEASFPAPLYSDDYLSLEGSRWPPAIRQATRWKYTPMGRDAAGQLWYTGLTNSDAWEAWYNLPRAPASPFREAYNRWHSCYQHRECSMPSAYTQHLRETAWHDPIVPAQYQAPSTRWGSALWKDRPIRGKEYVLNRNRYGVEPLWRASDYVPSLSAPQRPPGTTQNYREWVLEPYCPSTCQRSPPSLTPTPR

SEQ ID NO: 16288 - protein, 129 aa, Homo sapiens
  Payload ID: 3242
  Gene Symbol: C19orf73
  Gene Name: chromosome 19 open reading frame 73
  Uniprot ID: Q9NVV2
  ENSP ID: ENSP00000386230
MRLKVGFQGGGCFRKDALCLEGGVSARWARAPHSAPLRPPRELHAAPPPATPTQTVVRPAGFPRRTRLMVRSAPPTQRPPTGSGCVSGLWRKGLGLRPQTLLRVGSVVLSSAPALRPRLGPCLRPPPSD

SEQ ID NO: 16289 - protein, 198 aa, Homo sapiens
  Payload ID: 3243
  Gene Symbol: C19orf80
  Gene Name: chromosome 19 open reading frame 80
  Uniprot ID: Q6UXH0
  ENSP ID: ENSP00000252453
MPVPALCLLWALAMVTRPASAAPMGGPELAQHEELTLLFHGTLQLGQALNGVYRTTEGRLTKARNSLGLYGRTIELLGQEVSRGRDAAQELRASLLETQMEEDILQLQAEATAEVLGEVAQAQKVLRDSVQRLEVQLRSAWLGPAYREFEVLKAHADKQSHILWALTGHVQRQRREMVAQQHRLRQIQERLHTAALPA

SEQ ID NO: 16290 - protein, 99 aa, Homo sapiens
  Payload ID: 3243
  Gene Symbol: C19orf80
  Gene Name: chromosome 19 open reading frame 80
  ENSP ID: ENSP00000464941
MEEDILQLQAEATAEVLGEVAQAQKVLRDSVQRLEVQLRSAWLGPAYREFEVLKAHADKQSHILWALTGHVQRQRREMVAQQHRLRQIQERLHTAALPA

SEQ ID NO: 16291 - protein, 58 aa, Homo sapiens
  Payload ID: 3243
  Gene Symbol: C19orf80
  Gene Name: chromosome 19 open reading frame 80
  ENSP ID: ENSP00000465378
  MOD_RES (1)..(1): Any amino acid
XAQELRASLLETQAHADKQSHILWALTGHVQRQRREMVAQQHRLRQIQERLHTAALPA

SEQ ID NO: 16292 - protein, 198 aa, Homo sapiens; identical to SEQ ID NO: 16289
  Payload ID: 3243
  Gene Symbol: C19orf80
  Gene Name: chromosome 19 open reading frame 80
  Uniprot ID: Q6UXH0
  ENSP ID: ENSP00000479969

SEQ ID NO: 16293 - protein, 157 aa, Homo sapiens
  Payload ID: 3244
  Gene Symbol: C19orf81
  Gene Name: chromosome 19 open reading frame 81
  ENSP ID: ENSP00000391035
MDLETPEEMQARSLGRPIKSSKQYLRQVIAEYEALDRELPCIRKFPTPPASQPLCLCMETLPEEDFTHLEVLQALEAQLPGAMESGRVSSIRFENMNVICGTAGRRNRWLIAVTDFQTRSRLLRSGLSPRGLAHQIVRHDDLLLGDYRLHLRRSLVR

SEQ ID NO: 16294 - protein, 198 aa, Homo sapiens
  Payload ID: 3244
  Gene Symbol: C19orf81
  Gene Name: chromosome 19 open reading frame 81
  Uniprot ID: C9J6K1
  ENSP ID: ENSP00000417035
MQPEVEPVCFPAMGSPTMHRKAGALLMDLETPEEMQARSLGRPIKSSKQYLRQVIAEYEALDRELPCIRKFPTPPASQPLCLCMETLPEEDFTHLEVLQALEAQLPGAMESGRVSSIRFENMNVICGTAGRRNRWLIAVTDFQTRSRLLRSGLSPRGLAHQIVRHDDLLLGDYRLHLRRSLVRRRMLEALGAEPNEEA

SEQ ID NO: 16295 - protein, 186 aa, Homo sapiens
  Payload ID: 3245
  Gene Symbol: C19orf84
  Gene Name: chromosome 19 open reading frame 84
  Uniprot ID: I3L1E1
  ENSP ID: ENSP00000458772
MEQPKDGAGPEGNNLSLPSSGTEPWPPAPLPAPPPLLLNSTDPTHLGLPESVASVTVPIRLDTLSCLLHSALLGAYTFQQALPSCPCCSQAGHSQPGAVRRPPRGRGGWEVRHRPGWGRGLHRRGLGRAEQPERGRAGGPGAGPRTPPMTLPSPPTLPAQDGKKEARGPEPPLETPLAAEDWETEY

SEQ ID NO: 16296 - protein, 38 aa, Homo sapiens
  Payload ID: 3245
  Gene Symbol: C19orf84
  Gene Name: chromosome 19 open reading frame 84
  ENSP ID: ENSP00000466779
MTLPSPPTLPAQDGKKEARGPEPPLETPLAAEDWETEY

SEQ ID NO: 16297 - protein, 125 aa, Homo sapiens
  Payload ID: 3246
  Gene Symbol: C2orf15
  Gene Name: chromosome 2 open reading frame 15
  Uniprot ID: Q8WU43
  ENSP ID: ENSP00000302202
MSSTLGKLSNQVEETLPLLKKVPANYFHICSAILMGFSLSKSATQVSAIHMDSKVDDHLIRGTEKSRLEPATQLFQNTKKIRLEDTNQENFTRIEGTGTGSLSGKALGSVVYVKESDGLEMTDVE

SEQ ID NO: 16298 - protein, 125 aa, Homo sapiens; identical to SEQ ID NO: 16297
  Payload ID: 3246
  Gene Symbol: C2orf15
  Gene Name: chromosome 2 open reading frame 15
  Uniprot ID: Q8WU43
  ENSP ID: ENSP00000386654

SEQ ID NO: 16299 - protein, 1984 aa, Homo sapiens
  Payload ID: 3247
  Gene Symbol: C2orf16
  Gene Name: chromosome 2 open reading frame 16
  Uniprot ID: Q68DN1
  ENSP ID: ENSP00000386190
MELTPGAQQQGINYQELTSGWQDVKSMMLVPEPTRKFPSGPLLTSVRFSNLSPESQQQDVKSLEFTVEPKLQSVKHVKLSSVSLQQTIKSVELAPGSLPQRVKYGEQTPRTNYQIMESSELIPRPGHQFAKYAEMIPQPKYQIPKSANLISIPIYHATESSEMAQGLAYKGIDTVEKSVGLTPKLTGRAKESLGMLLQPDLQVPKFVDLTPMVRDQGSKFLGLTPEKSYQILETMELLSQSRPRVKDVGELYMKPLQQTVEYEGITPELKHYFTEAMGLTAEARIQANEFFGMTPKPTSQATGFAERSPRLCPQNLECVEVISEKRLQGEESVVLIPKSLHHVPDSASGMTPGLGHRVPESVELTSKSGVQVEKTLQLTPKPQHHVGSPGIISGLGHQVPESVNLTCKQWLQMEESLEVPLKQTSQVIGHEESVELTSEARQHREVSMGLTKSKNQSMKSPGTTPGPLGRIVEFMRISPEPLDQVTESARTQLQVAQSEEVILIDVPKVVQSVKVTPGPPFQIVKSVTIPRPTPQMVEYIELTPKLQYVRPSEHHTGPCLQDVKSTKLITKPKHQILETVELTGFQIVKTMLIPGPSLQIVKSEELAPGPIPQVVEPIGVALESGIEAINCVDLLPRPHLQELIVPAELTPSPCTQVKSAELTSPQTSPFEEHTILTHKQGLQAVKSTVIKTEPPKVMETEDLNLGHVCQNRDCQKLTSEELQVGTDFSRFLQSSSTTLISSSVRTASELGGLWDSGIQEVSRALDIKNPGTDILQPEETYIDPTMIQSLTFPLALHNQSSDKTANIVENPCPEILGVDVISKETTKRKQMEELENSLQRHLPQSWRSRSRTFQAESGVQKGLIKSFPGRQHNVWESHAWRQRLPRKYLSTMLMLGNILGTTMERKLCSQTSLAERATADTCQSIQNLFGIPAELMEPSQSLPEKGPVTISQPSVVKNYIQRHTFYHGHKKRMALRIWTRGSTSSIIQQYSGTRVRIKKTNSTFNGISQEVIQHMPVSCAGGQLPVLVKSESSLSIFYDREDLVPMEESEDSQSDSQTRISESQHSLKPNYLSQAKTDFSEQFQLLEDLQLKIAAKLLRSQIPPDVPPPLASGLVLKYPICLQCGRCSGLNCHHKLQTTSGPYLLIYPQLHLVRTPEGHGEVRLHLGFRLRIGKRSQISKYRERDRPVIRRSPISPSQRKAKIYTQASKSPTSTIDLQSGPSQSPAPVQVYIRRGQRSRPDLVEKTKTRAPGHYEFTQVHNLPESDSESTQNEKRAKVRTKKTSDSKYPMKRITKRLRKHRKFYTNSRTTIESPSRELAAHLRRKRIGATQTSTASLKRQPKKPSQPKFMQLLFQSLKRAFQTAHRVIASVGRKPVDGTRPDNLWASKNYYPKQNARDYCLPSSIKRDKRSADKLTPAGSTIKQEDILWGGTVQCRSAQQPRRAYSFQPRPLRLPKPTDSQSGIAFQTASVGQPLRTVQKDSSSRSKKNFYRNETSSQESKNLSTPGTRVQARGRILPGSPVKRTWHRHLKDKLTHKEHNHPSFYRERTPRGPSERTRHNPSWRNHRSPSERSQRSSLERRHHSPSQRSHCSPSRKNHSSPSERSWRSPSQRNHCSPPERSCHSLSERGLHSPSQRSHRGPSQRRHHSPSERSHRSPSERSHRSSSERRHRSPSQRSHRGPSERSHCSPSERRHRSPSQRSHRGPSERRHHSPSKRSHRSPARRSHRSPSERSHHSPSERSHHSPSERRHHSPSERSHCSPSERSHCSPSERRHRSPSERRHHSPSEKSHHSPSERSHHSPSERRRHSPLERSRHSLLERSHRSPSERRSHRSFERSHRRISERSHSPSEKSHLSPLERSRCSPSERRGHSSSGKTCHSPSERSHRSPSGMRQGRTSERSHRSSCERTRHSPSEMRPGRPSGRNHCSPSERSRRSPLKEGLKYSFPGERPSHSLSRDFKNQTTLLGTTHKNPKAGQVWRPEATR

SEQ ID NO: 16300 - protein, 148 aa, Homo sapiens
  Payload ID: 3248
  Gene Symbol: C2orf40
  Gene Name: chromosome 2 open reading frame 40
  Uniprot ID: Q9H1Z8
  ENSP ID: ENSP00000238044
MAASPARPAVLALTGLALLLLLCWGPGGISGNKLKLMLQKREAPVPTKTKVAVDENKAKEFLGSLKRQKRQLWDRTRPEVQQWYQQFLYMGFDEAKFEDDITYWLNRDRNGHEYYGDYYQRHYDEDSAIGPRSPYGFRHGASVNYDDY

SEQ ID NO: 16301 - protein, 112 aa, Homo sapiens
  Payload ID: 3248
  Gene Symbol: C2orf40
  Gene Name: chromosome 2 open reading frame 40
  ENSP ID: ENSP00000386421
MLQKREAPVPTKTKVAVDENKAKEFLGSLKRQKRQLWDRTRPEVQQWYQQFLYMGFDEAKFEDDITYWLNRDRNGHEYYGDYYQRHYDEDSAIGPRSPYGFRHGASVNYDDY

SEQ ID NO: 16302 - protein, 142 aa, Homo sapiens
  Payload ID: 3248
  Gene Symbol: C2orf40
  Gene Name: chromosome 2 open reading frame 40
  ENSP ID: ENSP00000388664
MQQLRVRGSYRSASQFAGWRRVFYQARQGGISGNKLKLMLQKREAPVPTKTKVAVDENKAKEFLGSLKRQKRQLWDRTRPEVQQWYQQFLYMGFDEAKFEDDITYWLNRDRNGHEYYGDYYQRHYDEDSAIGPRSPYGFRHG

SEQ ID NO: 16303 - protein, 574 aa, Homo sapiens
  Payload ID: 3249
  Gene Symbol: C2orf42
  Gene Name: chromosome 2 open reading frame 42
  Uniprot ID: Q9NWW7
  ENSP ID: ENSP00000264434
MEPNSLRTKVPAFLSDLGKATLRGIRKCPRCGTYNGTRGLSCKNKTCGTIFRYGARKQPSVEAVKIITGSDLQVYSVRQRDRGPDYRCFVELGVSETTIQTVDGTIITQLSSGRCYVPSCLKAATQGVVENQCQHIKLAVNCQAEATPLTLKSSVLNAMQASPETKQTIWQLATEPTGPLVQRITKNILVVKCKASQKHSLGYLHTSFVQKVSGKSLPERRFFCSCQTLKSHKSNASKDETAQRCIHFFACICAFASDETLAQEFSDFLNFDSSGLKEIIVPQLGCHSESTVSACESTASKSKKRRKDEVSGAQMNSSLLPQDAVSSNLRKSGLKKPVVASSLKRQACGQLLDEAQVTLSFQDWLASVTERIHQTMHYQFDGKPEPLVFHIPQSFFDALQQRISIGSAKKRLPNSTTAFVRKDALPLGTFSKYTWHITNILQVKQILDTPEMPLEITRSFIQNRDGTYELFKCPKVEVESIAETYGRIEKQPVLRPLELKTFLKVGNTSPDQKEPTPFIIEWIPDILPQSKIGELRIKFEYGHHRNGHVAEYQDQRPPLDQPLELAPLTTITFP

SEQ ID NO: 16304 - protein, 59 aa, Homo sapiens
  Payload ID: 3249
  Gene Symbol: C2orf42
  Gene Name: chromosome 2 open reading frame 42
  ENSP ID: ENSP00000388437
MEPNSLRTKVPAFLSDLGKATLRGIRKCPRCGTYNGTRGLSCKNKTCGTIFRYGARKQP

SEQ ID NO: 16305 - protein, 127 aa, Homo sapiens
  Payload ID: 3249
  Gene Symbol: C2orf42
  Gene Name: chromosome 2 open reading frame 42
  ENSP ID: ENSP00000389921
MEPNSLRTKVPAFLSDLGKATLRGIRKCPRCGTYNGTRGLSCKNKTCGTIFRYGARKQPSVEAVKIITGSDLQVYSVRQRDRGPDYRCFVELGVSETTIQTVDGTIITQLSSGRCYVPSCLKAATQG

SEQ ID NO: 16306 - protein, 112 aa, Homo sapiens
  Payload ID: 3249
  Gene Symbol: C2orf42
  Gene Name: chromosome 2 open reading frame 42
  ENSP ID: ENSP00000391119
MEPNSLRTKVPAFLSDLGKATLRGIRKCPRCGTYNGTRGLSCKNKTCGTIFRYGARKQPSVEAVKIITGSDLQVYSVRQRDRGPDYRCFVELGVSETTIQTVDGTIITQLSS

SEQ ID NO: 16307 - protein, 60 aa, Homo sapiens
  Payload ID: 3249
  Gene Symbol: C2orf42
  Gene Name: chromosome 2 open reading frame 42
  ENSP ID: ENSP00000394401
MEPNSLRTKVPAFLSDLGKATLRGIRKCPRCGTYNGTRGLSCKNKTCGTIFRYGARKQPS

SEQ ID NO: 16308 - protein, 168 aa, Homo sapiens
  Payload ID: 3249
  Gene Symbol: C2orf42
  Gene Name: chromosome 2 open reading frame 42
  ENSP ID: ENSP00000396751
MEPNSLRTKVPAFLSDLGKATLRGIRKCPRCGTYNGTRGLSCKNKTCGTIFRYGARKQPSVEAVKIITGSDLQVYSVRQRDRGPDYRCFVELGVSETTIQTVDGTIITQLSSGRCYVPSCLKAATQGVVENQCQHIKLAVNCQAEATPLTLKSSVLNAMQASPETKQT

SEQ ID NO: 16309 - protein, 22 aa, Homo sapiens
  Payload ID: 3249
  Gene Symbol: C2orf42
  Gene Name: chromosome 2 open reading frame 42
  ENSP ID: ENSP00000399442
MEPNSLRTKVPAFLSDLGKATL

SEQ ID NO: 16310 - protein, 574 aa, Homo sapiens; identical to SEQ ID NO: 16303
  Payload ID: 3249
  Gene Symbol: C2orf42
  Gene Name: chromosome 2 open reading frame 42
  Uniprot ID: Q9NWW7
  ENSP ID: ENSP00000404515

SEQ ID NO: 16311 - protein, 31 aa, Homo sapiens
  Payload ID: 3249
  Gene Symbol: C2orf42
  Gene Name: chromosome 2 open reading frame 42
  ENSP ID: ENSP00000405955
MEPNSLRTKVPAFLSDLGKATLRGIRKCPRC

SEQ ID NO: 16312 - protein, 159 aa, Homo sapiens
  Payload ID: 3249
  Gene Symbol: C2orf42
  Gene Name: chromosome 2 open reading frame 42
  ENSP ID: ENSP00000407799
MEPNSLRTKVPAFLSDLGKATLRGIRKCPRCGTYNGTRGLSCKNKTCGTIFRYGARKQPSVEAVKIITGSDLQVYSVRQRDRGPDYRCFVELGVSETTIQTVDGTIITQLSSGRCYVPSCLKAATQGVVENQCQHIKLAVNCQAEATPLTLKSSVLNAM

SEQ ID NO: 16313 - protein, 721 aa, Homo sapiens
  Payload ID: 3250
  Gene Symbol: C2orf44
  Gene Name: chromosome 2 open reading frame 44
  Uniprot ID: Q9H6R7
  ENSP ID: ENSP00000295148
MELGKGKLLRTGLNALHQAVHPIHGLAWTDGNQVVLTDLRLHSGEVKFGDSKVIGQFECVCGLSWAPPVADDTPVLLAVQHEKHVTVWQLCPSPMESSKWLTSQTCEIRGSLPILPQGCVWHPKCAILTVLTAQDVSIFPNVHSDDSQVKADINTQGRIHCACWTQDGLRLVVAVGSSLHSYIWDSAQKTLHRCSSCLVFDVDSHVCSITATVDSQVAIATELPLDKICGLNASETFNIPPNSKDMTPYALPVIGEVRSMDKEATDSETNSEVSVSSSYLEPLDLTHIHFNQHKSEGNSLICLRKKDYLTGTGQDSSHLVLVTFKKAVTMTRKVTIPGILVPDLIAFNLKAHVVAVASNTCNIILIYSVIPSSVPNIQQIRLENTERPKGICFLTDQLLLILVGKQKLTDTTFLPSSKSDQYAISLIVREIMLEEEPSITSGESQTTYSTFSAPLNKANRKKLIESLSPDFCHQNKGLLLTVNTSSQNGRPGRTLIKEIQSPLSSICDGSIALDAEPVTQPASLPRHSSTPDHTSTLEPPRLPQRKNLQSEKETYQLSKEVEILSRNLVEMQRCLSELTNRLHNGKKSSSVYPLSQDLPYVHIIYQKPYYLGPVVEKRAVLLCDGKLRLSTVQQTFGLSLIEMLHDSHWILLSADSEGFIPLTFTATQEIIIRDGSLSRSDVFRDSFSHSPGAVSSLKVFTGLAAPSLDTTGCCNHVDGMA

SEQ ID NO: 16314 - protein, 622 aa, Homo sapiens
  Payload ID: 3250
  Gene Symbol: C2orf44
  Gene Name: chromosome 2 open reading frame 44
  Uniprot ID: Q9H6R7
  ENSP ID: ENSP00000385816
MELGKGKLLRTGLNALHQAVHPIHGLAWTDGNQVVLTDLRLHSGEVKFGDSKVIGQFECVCGLSWAPPVADDTPVLLAVQHEKHVTVWQLCPSPMESSKWLTSQTCEIRGSLPILPQGCVWHPKCAILTVLTAQDVSIFPNVHSDDSQVKADINTQGRIHCACWTQDGLRLVVAVGSSLHSYIWDSAQKTLHRCSSCLVFDVDSHVCSITATVDSQVAIATELPLDKICGLNASETFNIPPNSKDMTPYALPVIGEVRSMDKEATDSETNSEVSVSSSYLEPLDLTHIHFNQHKSEGNSLICLRKKDYLTGTGQDSSHLVLVTFKKAVTMTRKVTIPGILVPDLIAFNLKAHVVAVASNTCNIILIYSVIPSSVPNIQQIRLENTERPKGICFLTDQLLLILVGKQKLTDTTFLPSSKSDQYAISLIVREIMLEEEPSITSGESQTTYSTFSAPLNKANRKKLIESLSPDFCHQNKGLLLTVNTSSQNGRPGRTLIKEIQSPLSSICDGSIALDAEPVTQPASLPRHSSTPDHTSTLEPPRLPQRKNLQSEKETYQLSKEVEILSRNLVEMQRCLSELTNRLHNGKKSSSVYPLSQDLPYVHIIYQIPTGFFSLLTVRALSR

SEQ ID NO: 16315 - protein, 174 aa, Homo sapiens
  Payload ID: 3250
  Gene Symbol: C2orf44
  Gene Name: chromosome 2 open reading frame 44
  ENSP ID: ENSP00000413426
MELGKGKLLRTGLNALHQAVHPIHGLAWTDGNQVVLTDLRLHSGEVKFGDSKVIGQFECVCGLSWAPPVADDTPVLLAVQHEKHVTVWQLCPSPMESSKWLTSQTCEIRGSLPILPQGCVWHPKCAILTVLTAQDVSIFPNVHSDDSQVKADINTQGRIHCACWTQDGLRLVVA

SEQ ID NO: 16316 - protein, 291 aa, Homo sapiens
  Payload ID: 3251
  Gene Symbol: C2orf47
  Gene Name: chromosome 2 open reading frame 47
  Uniprot ID: Q8WWC4
  ENSP ID: ENSP00000295079
MALAARLLPQFLHSRSLPCGAVRLRTPAVAEVRLPSATLCYFCRCRLGLGAALFPRSARALAASALPAQGSRWPVLSSPGLPAAFASFPACPQRSYSTEEKPQQHQKTKMIVLGFSNPINWVRTRIKAFLIWAYFDKEFSITEFSEGAKQAFAHVSKLLSQCKFDLLEELVAKEVLHALKEKVTSLPDNHKNALAANIDEIVFTSTGDISIYYDEKGRKFVNILMCFWYLTSANIPSETLRGASVFQVKLGNQNVETKQLLSASYEFQREFTQGVKPDWTIARIEHSKLLE

SEQ ID NO: 16317 - protein, 291 aa, Homo sapiens; identical to SEQ ID NO: 16316
  Payload ID: 3251
  Gene Symbol: C2orf47
  Gene Name: chromosome 2 open reading frame 47
  Uniprot ID: Q8WWC4
  ENSP ID: ENSP00000376111

SEQ ID NO: 16318 - protein, 225 aa, Homo sapiens
  Payload ID: 3251
  Gene Symbol: C2orf47
  Gene Name: chromosome 2 open reading frame 47
  ENSP ID: ENSP00000396846
  MOD_RES (1)..(1): Any amino acid
XPQFLHSRSLPCGAVRLRTPAVAEVRLPSATLCYFCRCRLGLGAALFPRSARALAASALPAQGSRWPVLSSPGLPAAFASFPACPQRSYSTEEKPQQHQKTKMIVLGFSNPINWVRTRIKAFLIWAYFDKEFSITEFSEGAKQAFAHVSKLLSQCKFDLLEELVAKEVLHALKEKVTSLPDNHKNALAANIDEIVFTSTGDISIYYDEKGKYLSVELLDYERKRP

SEQ ID NO: 16319 - protein, 232 aa, Homo sapiens
  Payload ID: 3252
  Gene Symbol: C2orf49
  Gene Name: chromosome 2 open reading frame 49
  Uniprot ID: Q9BVC5
  ENSP ID: ENSP00000258457
MAGDVGGRSCTDSELLLHPELLSQEFLLLTLEQKNIAVETDVRVNKDSLTDLYVQHAIPLPQRDLPKNRWGKMMEKKREQHEIKNETKRSSTVDGLRKRPLIVFDGSSTSTSIKVKKTENGDNDRLKPPPQASFTSNAFRKLSNSSSSVSPLILSSNLPVNNKTEHNNNDAKQNHDLTHRKSPSGPVKSPPLSPVGTTPVKLKRAAPKEEAEAMNNLKPPQAKRKIQHVTWP

SEQ ID NO: 16320 - protein, 190 aa, Homo sapiens
  Payload ID: 3252
  Gene Symbol: C2orf49
  Gene Name: chromosome 2 open reading frame 49
  ENSP ID: ENSP00000386361
MAGDVGGRSCTDSELLLHPELLSQEFLLLTLEQKNIAVETDVRVNKDSLTDLYVQHAIPLPQRDLPKNRWGKMMEKKREQHEIKNETKRSSTVDGLRKRPLIVFDGSSTSTSIKVKKTENGDNDRLKPPPQNHDLTHRKSPSGPVKSPPLSPVGTTPVKLKRAAPKEEAEAMNNLKPPQAKRKIQHVTWP

SEQ ID NO: 16321 - protein, 162 aa, Homo sapiens
  Payload ID: 3253
  Gene Symbol: C2orf50
  Gene Name: chromosome 2 open reading frame 50
  Uniprot ID: Q96LR7
  ENSP ID: ENSP00000370997
MGSHPTPGLQRTTSAGYRLPPTRPPASVSPAARGGPMASRGLAGGCQAPQALKAQRVAQGAACDGVQQDQLWRELLEAERRGQQRWIQNWSFLKDYDPMGNKKEPEKLPDHVPLFSDTVPSSTNQVVGSRLDTPLGQTLIRMDFFFTEGARKKKLEDQMQPI

SEQ ID NO: 16322 - protein, 162 aa, Homo sapiens; identical to SEQ ID NO: 16321
  Payload ID: 3253
  Gene Symbol: C2orf50
  Gene Name: chromosome 2 open reading frame 50
  Uniprot ID: Q96LR7
  ENSP ID: ENSP00000384186

SEQ ID NO: 16323 - protein, 298 aa, Homo sapiens
  Payload ID: 3254
  Gene Symbol: C2orf54
  Gene Name: chromosome 2 open reading frame 54
  Uniprot ID: Q08AI8
  ENSP ID: ENSP00000302779
MDTGVWGWGAAACRWGPAERAAGSLNAASLREEQLHLSLLVSSGWRTISFHVVPVVRRKLGAPALEGVQQMPGFPEGSLRRILSQGVDLVPASAQLWRTSTDYLLTRLLGELGSLQGHRLDSLSILDRVNHESWRDSGQTDGLTFGHLKMVLLWASVLFLAPEDWAELQGAVYRLLVVLLCCLATRKLPHFLHPQRNLLQGSGLDLGAIYQRVEGFASQPEAALRIHATHLGRSPPPRIGSGLKALLQLPASDPTYWATAYFDVLLDKFQVFNIQDKDRISAMQSIFQKTRTLGGEES

SEQ ID NO: 16324 - protein, 447 aa, Homo sapiens
  Payload ID: 3254
  Gene Symbol: C2orf54
  Gene Name: chromosome 2 open reading frame 54
  Uniprot ID: Q08AI8
  ENSP ID: ENSP00000373586
MPAPALPTSAMAVQVPLWHHYLQAIRSREAPRAQDFQRAENVLLTVLERVHALDPRFIVDYSRGLEAFQFALRSSEDPMDMEVPLWVDAEALLIEEPEATQPEDGLELCHLGVPREGAGLERWTTEDTFTASSEGDAKCRGHIVPSKVLCVLKDLLVAAIVHCKHHSLIAPGSLNAASLREEQLHLSLLVSSGWRTISFHVVPVVRRKLGAPALEGVQQMPGFPEGSLRRILSQGVDLVPASAQLWRTSTDYLLTRLLGELGSLQGHRLDSLSILDRVNHESWRDSGQTDGLTFGHLKMVLLWASVLFLAPEDWAELQGAVYRLLVVLLCCLATRKLPHFLHPQRNLLQGSGLDLGAIYQRVEGFASQPEAALRIHATHLGRSPPPRIGSGLKALLQLPASDPTYWATAYFDVLLDKFQVFNIQDKDRISAMQSIFQKTRTLGGEES

SEQ ID NO: 16325 - protein, 279 aa, Homo sapiens
  Payload ID: 3254
  Gene Symbol: C2orf54
  Gene Name: chromosome 2 open reading frame 54
  Uniprot ID: Q08AI8
  ENSP ID: ENSP00000385338
MDTGSLNAASLREEQLHLSLLVSSGWRTISFHVVPVVRRKLGAPALEGVQQMPGFPEGSLRRILSQGVDLVPASAQLWRTSTDYLLTRLLGELGSLQGHRLDSLSILDRVNHESWRDSGQTDGLTFGHLKMVLLWASVLFLAPEDWAELQGAVYRLLVVLLCCLATRKLPHFLHPQRNLLQGSGLDLGAIYQRVEGFASQPEAALRIHATHLGRSPPPRIGSGLKALLQLPASDPTYWATAYFDVLLDKFQVFNIQDKDRISAMQSIFQKTRTLGGEES

SEQ ID NO: 16326 - protein, 132 aa, Homo sapiens
  Payload ID: 3254
  Gene Symbol: C2orf54
  Gene Name: chromosome 2 open reading frame 54
  ENSP ID: ENSP00000390935
MPAPALPTSAMAVQVPLWHHYLQAIRSREAPRAQDFQRAENVLLTVLERVHALDPRFIVDYSRGLEAFQFALRSSEDPMDMEVPLWVDAEALLIEEPEATQPEDGLELCHLGVPREGAGLERWTTEDTFTAS

SEQ ID NO: 16327 - protein, 108 aa, Homo sapiens
  Payload ID: 3254
  Gene Symbol: C2orf54
  Gene Name: chromosome 2 open reading frame 54
  ENSP ID: ENSP00000394874
MAVQVPLWHHYLQAIRSREAPRAQDFQRAENVLLTVLERVHALDPRFIVDYSRGLEAFQFALRSSEDPMDMEVPLWVDAEALLIEEPEATQPEDGLELCHLGVPREGA

SEQ ID NO: 16328 - protein, 395 aa, Homo sapiens
  Payload ID: 3255
  Gene Symbol: C2orf57
  Gene Name: chromosome 2 open reading frame 57
  Uniprot ID: Q53QW1
  ENSP ID: ENSP00000315557
MALPGYPLGNVDDSRSKDSPAGEPQGQVPLTADVLAVSSSVASTDWQDIDQASFKTATPRAISTSGDKDKSAVVPEHGQKTPRKITPLLPSQNPSPLQVSMSLQNPAWDRQVQDARTSQSLVVFPSHLLGKDKMSQMASVPEREPESAPSAPSAELQSTQHMEAQPVESDADHVTAGANGQHGPQAASTTKSAEEKAEHPKAPHPEAEALPSDESPVAMGANVVDSLGDLQTWFFPPPPAGSVSPSPGPHEVALGRRPLDSSLYTASEENSYMRSMTSLLDRGEGSISSLADILVWSETTMGMAIATGFLDSGHSTVADLLHSSGPSLRSVPSLVGSVSSAFSSGLVSGTSSALRTITRVLETVEQRTVEGIRSAMRYLTSHLTPRQAQADPNYD

SEQ ID NO: 16329 - protein, 177 aa, Homo sapiens
  Payload ID: 3256
  Gene Symbol: C2orf61
  Gene Name: chromosome 2 open reading frame 61
  Uniprot ID: Q8N801
  ENSP ID: ENSP00000294947
MDQPAVATASTSIREDLVGGESFITASKPAQKTSSFEREGWWRIALTDTPIPGTYHLKTFIEESLLNPVIATYNFKNEGRKKPPLVQRNNPVLNDLPQYMPPDFLDLLKKQVATYSFKDKPRPSPSTLVDKDQSLQLSPGQYNVLPAPVPKYASRSCVFRSTVQRFPTTYFIPVSIM

SEQ ID NO: 16330 - protein, 248 aa, Homo sapiens
  Payload ID: 3256
  Gene Symbol: C2orf61
  Gene Name: chromosome 2 open reading frame 61
  Uniprot ID: Q8N801
  ENSP ID: ENSP00000408527
MDQPAVATASTSIREDLVGGESFITASKPAQKTSSFEREGWWRIALTDTPIPGTYHLKTFIEESLLNPVIATYNFKNEGRKKPPLVQRNNPVLNDLPQYMPPDFLDLLKKQVATYSFKDKPRPSPSTLVDKDQSLQLSPGQYNVLPAPVPKYASRSCVFRSTVQRFPTTYFIPHEGPGPGHYNVKMPPTSSVTSCFQSRVPRFLPSCSKTPGPGAYTTLRQFPKQSPTIAKMGQEHSLFFNNNNWLLK

SEQ ID NO: 16331 - protein, 128 aa, Homo sapiens
  Payload ID: 3256
  Gene Symbol: C2orf61
  Gene Name: chromosome 2 open reading frame 61
  ENSP ID: ENSP00000414210
  MOD_RES (1)..(1): Any amino acid
XRPSPSTLVDKDQSLQLSPGQYNVLPAPVPKYASRSCVFRSTVQRFPTTYFIPHEGPGPGHYNVKMPPTSSVTSCFQSRVPRFLPSCSKTPGPGAYTTLRQFPKQSPTIAKMGQEHSLFFNNNNWLLK

SEQ ID NO: 16332 - protein, 117 aa, Homo sapiens
  Payload ID: 3257
  Gene Symbol: C2orf66
  Gene Name: chromosome 2 open reading frame 66
  Uniprot ID: Q6UXQ4
  ENSP ID: ENSP00000339384
MIIDSSRIPSFTQLHSTMTRAPLLLLCVALVLLGHVNGATVRNEDKWKPLNNPRNRDLFFRRLQAYFKGRGLDLGTFPNPFPTNENPRPLSFQSELTASASADYEEQKNSFHNYLKG

SEQ ID NO: 16333 - protein, 166 aa, Homo sapiens
  Payload ID: 3258
  Gene Symbol: C2orf68
  Gene Name: chromosome 2 open reading frame 68
  Uniprot ID: Q2NKX9
  ENSP ID: ENSP00000304410
MEAGPHPRPGHCCKPGGRLDMNHGFVHHIRRNQIARDDYDKKVKQAAKEKVRRRHTPAPTRPRKPDLQVYLPRHRDVSAHPRNPDYEESGESSSSGGSELEPSGHQLFCLEYEADSGEVTSVIVYQGDDPGKVSEKVSAHTPLDPPMREALKLRIQEEIAKRQSQH

SEQ ID NO: 16334 - protein, 127 aa, Homo sapiens
  Payload ID: 3258
  Gene Symbol: C2orf68
  Gene Name: chromosome 2 open reading frame 68
  Uniprot ID: Q2NKX9
  ENSP ID: ENSP00000386301
MEAGPHPRPGHCCKPGGRLDMNHGFVHHIRRNQIARDDYDKKVKQAAKEKVRRRHTPAPTRPRKPDLQVYLPRHRGEAARPACLQPARSSCNALPFSIGKNHFLLLRFSSSRLFPEPPPQRSQISAE

SEQ ID NO: 16335 - protein, 58 aa, Homo sapiens
  Payload ID: 3258
  Gene Symbol: C2orf68
  Gene Name: chromosome 2 open reading frame 68
  ENSP ID: ENSP00000395730
MEAGPHPRPGHCCKPGGRLDMNHGFVHHIRRNQIARYRPALRRRRHHSWPGLARPDSP

SEQ ID NO: 16336 - protein, 42 aa, Homo sapiens
  Payload ID: 3258
  Gene Symbol: C2orf68
  Gene Name: chromosome 2 open reading frame 68
  ENSP ID: ENSP00000401625
  MOD_RES (1)..(1): Any amino acid
XRLDMNHGFVHHIRRNQIARYRPALRRRRHHSWPGLARPDSP

SEQ ID NO: 16337 - protein, 385 aa, Homo sapiens
  Payload ID: 3259
  Gene Symbol: C2orf69
  Gene Name: chromosome 2 open reading frame 69
  Uniprot ID: Q8N8R5
  ENSP ID: ENSP00000312770
MWGFRLLRSPPLLLLLPQLGIGNASSCSQARTMNPGGSGGARCSLSAEVRRRQCLQLSTVPGADPQRSNELLLLAAAGEGLERQDLPGDPAKEEPQPPPQHHVLYFPGDVQNYHEIMTRHPENYQWENWSLENVATILAHRFPNSYIWVIKCSRMHLHKFSCYDNFVKSNMFGAPEHNTDFGAFKHLYMLLVNAFNLSQNSLSKKSLNVWNKDSIASNCRSSPSHTTNGCQGEKVRTCEKSDESAMSFYPPSLNDASFTLIGFSKGCVVLNQLLFELKEAKKDKNIDAFIKSIRTMYWLDGGHSGGSNTWVTYPEVLKEFAQTGIIVHTHVTPYQVRDPMRSWIGKEHKKFVQILGDLGMQVTSQIHFTKEAPSIENHFRVHEVF

SEQ ID NO: 16338 - protein, 201 aa, Homo sapiens
  Payload ID: 3260
  Gene Symbol: C2orf70
  Gene Name: chromosome 2 open reading frame 70
  Uniprot ID: A6NJV1
  ENSP ID: ENSP00000332875
MASRSAGTLLTEFNAAYVPPGLMPGYQGHVPTVAFSFGAPYGTTTLKYFQDHRNRAMEKSHTPFSQGGHFPTIFSTNPNLLLMERASTRDRWLHKPSYTRFNLDSHRSTELTNFYQMVQQHRKYYQDKTGTVPRVPYFAMPVREPERYPLPTVLPPLCPKKKWHLLRLAPENLKTYQTFPSGKRVSPQERKKRDCYFEFRA

SEQ ID NO: 16339 - protein, 184 aa, Homo sapiens
  Payload ID: 3260
  Gene Symbol: C2orf70
  Gene Name: chromosome 2 open reading frame 70
  ENSP ID: ENSP00000386615
MPWVDSDLKRFLVPGPRPHCGLLLWRSLRHHHPQVLPGPPQQSHGEEPHSLQPRRPFPHHLLHQPQPPADGARQHPGPLAAQAQLHSLQPGQPSLHRAYEFLPDGPAASEVLSRQDGHSASSPLLCDAREGAGTVPPPHRPASSVPKEEVAPFKTSPREPEDLPDLPIREEGLSTGAEKERLLL

SEQ ID NO: 16340 - protein, 128 aa, Homo sapiens
  Payload ID: 3260
  Gene Symbol: C2orf70
  Gene Name: chromosome 2 open reading frame 70
  ENSP ID: ENSP00000395924
  MOD_RES (1)..(1): Any amino acid
XLQPGQPSLHRAYEFLPDGPAASEVLSRQDGHSASSPLLCDAREGAGTVPPPHRPVAWPLALLLTVSQRTQRANQVVGRRGPPLCPKKKWHLLRLAPENLKTYQTFPSGKRVSPQERKKRDCYFEFRA

SEQ ID NO: 16341 - protein, 1288 aa, Homo sapiens
  Payload ID: 3261
  Gene Symbol: C2orf71
  Gene Name: chromosome 2 open reading frame 71
  Uniprot ID: A6NGG8
  ENSP ID: ENSP00000332809
MGCTPSHSDLVNSVAKSGIQFLKKPKAIRPGCQGGSERGSIPLLVKNSTCYDAGEGLAEEQPSPRRNQTTAKGLCQLMGDPASGKRKDMEGLIPGTKTSSSQLNKSQSHMAKDIPFKTQGSHGSQGADFSGDESEESSTQDTSKWKRTAKCHTSSTQSHCYQTIHPAHEPEGKVDFPEPLVKAHQQAYTYLHSSLSKYEAILCIIHQATQTRELLQPMVSFLLLCFEEISQLLGEISKDGEVLLQEVREDLAWPLKKREPQEQPNLLQQLLQYTVSKLQVLNGTVASLTGSFLEGSSSYLHSTATHLENKLSTKRNVDERLLRALRQLESLASGCGDPGVQGLPLCSEDSGIGADNESVQSVDKLGKQTSWDLAPEPEEWKSVTSPHTEARQSGHTWQQSPFCLGSGRPQDCLLSGAPMAKVQPRAQDEARSPCLSSTSPENITSPPLKLGTSTPCDSFGIGVSVEPHLSKTSRPMDASSLSDSEDSSPEEEEEDKMSSMSLCAWQEKTPHSRPQSSPADRESPFQARTRRLRSLQAQEMILKMKESISERIKFVPVPCGHQDWSEEEEGRTVVPPRPSTVSGSRRAPERQTRSQSESCLQSHVEDPTFQELRRVQRDLSQKLEAFYALGAKGQGQSQEQILQPRAAAVWPNGTCRVSPSNTTSRLKASLTKNFSILPSQDKSILQKCNPHPEDEQGKAGKLPNAIPSGEVSEAAKATDWNVRGCPTRTSVKKLIETFSPTESLRMLGDSKDAGASPCLRNCIMPPRFPKYTGLAPLYPKPQISPASGRESLKMGIGWKPLAPIFPPLPKAEAAKSEELSCEMEGNLEHLPPPPMEVLMDKSFASLESPESSKSTENSPKETQEPGPGEAGPTRRTWASPKLRASVSPLDLLPSKSTASLTKPHSTGPGSGRSSCQPRKPALDLSSPPATSQSPEVKGGTWSQAEKATSLYRQPRKAIAWHHSGPPSGQNRTSESSLARPRQSRERSPPVGRKASPTRTHWVPQADKRRRSLPSSYRPAQPSPSAVQTPPSPPVSPRVLSPPTTKRRTSPPHQPKLPNPPPESAPAQCKVPSPPTQHPEASPPFSIPSPSPPMSPSQEHKETRDSEDSQAVIAKVSGNTHSIFCPATSSLFEAKPPLSTAHPLTPPSLPPEAGGPLGNPAECWKNSSGPWLRADSQRRAALCALNPLPFLRRTASDRQPGGRPQPPTLDPTSTSYESQLGQNSSSEESPKKDTEPGSSPCSPELQGGTRRASPPEFCVLGHGLQPEPRTGHIQDKSQPEAQPQQEEVS

SEQ ID NO: 16342 - protein, 295 aa, Homo sapiens
  Payload ID: 3262
  Gene Symbol: C2orf72
  Gene Name: chromosome 2 open reading frame 72
  Uniprot ID: A6NCS6
  ENSP ID: ENSP00000362743
MERELEALAARLARPAEPPFQALVEAAGGRGQVLLVGELWEREQSRALLRDFARAVFPPEPGAAKPGGAAAEGAGPGAARGAQRAARAAGAAGAAAAAARAIRSPLVFVLCRASSLAAREPRRRLREMLRDVRGRRRAGAALVGVLVAEAGPEDAVAPGLRLLEALLRAVFGRQAGGPVQAAAYCPGLPASCLAVQAAACRALQAAGAGQPVEGAWERPGLPGLLACFSWGPWSRRKNQDVAACRSSAQEDFQEPEEELPLTAIFPNGDCDDLGRGSKACDGVVHTPAEPTGDSR

SEQ ID NO: 16343 - protein, 59 aa, Homo sapiens
  Payload ID: 3263
  Gene Symbol: C2orf73
  Gene Name: chromosome 2 open reading frame 73
  ENSP ID: ENSP00000325555
MEEKEDKHQVTGGHMVKHWNLSSYHLTTLRAPRGVTSKNHRVHWFCQSNTARCKSLLVE

SEQ ID NO: 16344 - protein, 287 aa, Homo sapiens
  Payload ID: 3263
  Gene Symbol: C2orf73
  Gene Name: chromosome 2 open reading frame 73
  Uniprot ID: Q8N5S3
  ENSP ID: ENSP00000381631
MEEKEDKHQQHKIEDAAITYVSENEEIKHEEKPGKSIHHSKSHVGRGRIYYAKFINTNARTYNEPFPYIDPKKGPEIQGDWWSHGKALEPVFLPPYDSKSTQRSDFQKPSCPLVLPVKHSKMQKPSCGIVPLASPGTSAELQNNFIEYISFIHQYDARKTPNEPLQGKRHGAFVQREIKPGSRPTVPKGAEVLLNTPGSRSSEQSKKTEKGNSAESRMISPGLCQQNSQELLEPKTHLSETDVRQAAKACPSTPESREKTSGATQTTVGDALFTRHKPLNPPIKKSE

SEQ ID NO: 16345 - protein, 113 aa, Homo sapiens
  Payload ID: 3263
  Gene Symbol: C2orf73
  Gene Name: chromosome 2 open reading frame 73
  ENSP ID: ENSP00000385348
MEEKEDKHQQHKIEDAAITYGDWWSHGKALEPVFLPPYDSKSTQRSDFQKPSCPLVLPVKHSKMQKPSCGIDETLRKGAKTVTVVLCHSAGRKGTERSRACFFRWFHAILFSP

SEQ ID NO: 16346 - protein, 211 aa, Homo sapiens
  Payload ID: 3263
  Gene Symbol: C2orf73
  Gene Name: chromosome 2 open reading frame 73
  ENSP ID: ENSP00000389570
MEEKEDKHQQHKIEDAAITYGDWWSHGKALEPVFLPPYDSKSTQRSDFQKPSCPLVLPVKHSKMQKPSCGIVPLASPGTSAELQNNFIEYISFIHQYDARKTPNEPLQGKRHGAFVQREIKPGSRPTVPKGAEVLLNTPGSRSSEQSKKTEKGNSAESRMISPGLCQQNSQELLEPKTHLSETDVRQAAKACPSTPESREKTSGATQTTVG

SEQ ID NO: 16347 - protein, 82 aa, Homo sapiens
  Payload ID: 3263
  Gene Symbol: C2orf73
  Gene Name: chromosome 2 open reading frame 73
  ENSP ID: ENSP00000403195
  MOD_RES (1)..(1): Any amino acid
XEDKHQQHKIEDAAITYGDWWSHGKALEPVFLPPYDSKSTQRSDFQKPSCPLVLPVKHSKMQKPSCGIETRSFCTERDKTRQ

SEQ ID NO: 16348 - protein, 223 aa, Homo sapiens
  Payload ID: 3263
  Gene Symbol: C2orf73
  Gene Name: chromosome 2 open reading frame 73
  ENSP ID: ENSP00000417971
MQVSNGFSQELALFGQHKIEDAAITYVSENEEIKHEEKPGKSIHHSKSHVGRGRIYYAKFINTNARTYNEPFPYIDPKKGPEIQGDWWSHGKALEPVFLPPYDSKSTQRSDFQKPSCPLVLPVKHSKMQKPSCGIVPLASPGTSAELQNNFIEYISFIHQYDARKTPNEPLQGKRHGAFVQREIKPGSRPTVPKGAEVLLNTPGSRSSEQSKKTEKGNSAESR

SEQ ID NO: 16349 - protein, 70 aa, Homo sapiens
  Payload ID: 3263
  Gene Symbol: C2orf73
  Gene Name: chromosome 2 open reading frame 73
  ENSP ID: ENSP00000481108
MISPGLCQQNSQELLEPKTHLSETDVRQAAKACPSTPESREKTSGATQTTVGDALFTRHKPLNPPIKKSE

SEQ ID NO: 16350 - protein, 52 aa, Homo sapiens
  Payload ID: 3264
  Gene Symbol: C2orf74
  Gene Name: chromosome 2 open reading frame 74
  ENSP ID: ENSP00000381621
MDQGLREVVGDSRMPWTIWSPSCCRSCHHEWTPSGHHSKEVCRQEMESRSVA

SEQ ID NO: 16351 - protein, 115 aa, Homo sapiens
  Payload ID: 3264
  Gene Symbol: C2orf74
  Gene Name: chromosome 2 open reading frame 74
  ENSP ID: ENSP00000398725
MQVMNLNVPMRPGILVQRQSKEVLATPLENRRDMEAEEENQINEKQEPENAGETGQEEDDGLQKIHTSVTRTPSVVESQKRPLKGVTFSREVIVVDLGNEYPTPRSYTREHKERK

SEQ ID NO: 16352 - protein, 194 aa, Homo sapiens
  Payload ID: 3264
  Gene Symbol: C2orf74
  Gene Name: chromosome 2 open reading frame 74
  Uniprot ID: A8MZ97
  ENSP ID: ENSP00000402915
MSLLAKPMSFETTAITFFIILLICLICILLLLVVFLYKCFQGRKGKETKKVPCTDANGGVDCAAAKVVTSNPEDHERILMQVMNLNVPMRPGILVQRQSKEVLATPLENRRDMEAEEENQINEKQEPENAGETGQEEDDGLQKIHTSVTRTPSVVESQKRPLKGVTFSREVIVVDLGNEYPTPRSYTREHKERK

SEQ ID NO: 16353 - protein, 28 aa, Homo sapiens
  Payload ID: 3264
  Gene Symbol: C2orf74
  Gene Name: chromosome 2 open reading frame 74
  ENSP ID: ENSP00000481253
MQVMNLNVPMRPGILVQRQSKEVLATPL

SEQ ID NO: 16354 - protein, 115 aa, Homo sapiens; identical to SEQ ID NO: 16351
  Payload ID: 3264
  Gene Symbol: C2orf74
  Gene Name: chromosome 2 open reading frame 74
  ENSP ID: ENSP00000482798

SEQ ID NO: 16355 - protein, 187 aa, Homo sapiens
  Payload ID: 3264
  Gene Symbol: C2orf74
  Gene Name: chromosome 2 open reading frame 74
  ENSP ID: ENSP00000484061
MSLLAKPMSFETTAITFFIILLICLICILLLLVVFLYKCFQGRKGKETKKVPCTDANGGVDCAAAKVVTSNPEDHERRVWCRMPGILVQRQSKEVLATPLENRRDMEAEEENQINEKQEPENAGETGQEEDDGLQKIHTSVTRTPSVVESQKRPLKGVTFSREVIVVDLGNEYPTPRSYTREHKERK

SEQ ID NO: 16356 - protein, 126 aa, Homo sapiens
  Payload ID: 3265
  Gene Symbol: C2orf76
  Gene Name: chromosome 2 open reading frame 76
  Uniprot ID: Q3KRA6
  ENSP ID: ENSP00000335041
MAPGEVTITVRLIRSFEHRNFKPVVYHGVNLDQTVKEFIVFLKQDIPLRTNLPPPFRNYKYDALKIIHQAHKSKTNELVLSLEDDERLLLKEDSTLKAAGIASETEIAFFCEEDYKNYKANPISSW

SEQ ID NO: 16357 - protein, 126 aa, Homo sapiens; identical to SEQ ID NO: 16356
  Payload ID: 3265
  Gene Symbol: C2orf76
  Gene Name: chromosome 2 open reading frame 76
  Uniprot ID: Q3KRA6
  ENSP ID: ENSP00000386302

SEQ ID NO: 16358 - protein, 126 aa, Homo sapiens; identical to SEQ ID NO: 16356
  Payload ID: 3265
  Gene Symbol: C2orf76
  Gene Name: chromosome 2 open reading frame 76
  Uniprot ID: Q3KRA6
  ENSP ID: ENSP00000386714

SEQ ID NO: 16359 - protein, 126 aa, Homo sapiens; identical to SEQ ID NO: 16356
  Payload ID: 3265
  Gene Symbol: C2orf76
  Gene Name: chromosome 2 open reading frame 76
  Uniprot ID: Q3KRA6
  ENSP ID: ENSP00000387234

SEQ ID NO: 16360 - protein, 85 aa, Homo sapiens
  Payload ID: 3265
  Gene Symbol: C2orf76
  Gene Name: chromosome 2 open reading frame 76
  ENSP ID: ENSP00000388482
MSSVMVESWTGLPKGEAEASSSELLEFLHMAPGEVTITVRLIRSFEHRNFKPVVYHGVNLDQTVKEFIVFLKQDIPLRTNLPPPF

SEQ ID NO: 16361 - protein, 922 aa, Homo sapiens
  Payload ID: 3266
  Gene Symbol: C2orf78
  Gene Name: chromosome 2 open reading frame 78
  Uniprot ID: A6NCI8
  ENSP ID: ENSP00000387124
MHWLASATQTSASIVSSSLLSAVDVSSSLTMSEYFQNTSLPGTANSRQFSLPVVSNAAFLTGSISNFSRASAPAISSAWLQPSASGTSFQPLMGSAYLYQHSSTTMLSGVTGQSHICTSAASYPGVFEWDSTASTVKKSSSLRDFTVTVIDQNTAVSSMSMTAQYYKTSDTNTMVPLYPSLSASLVQGTLTQIPNQQGHNLSLPCQIGSQVYYYNQGTLGPQLSCLQSYGSVSYTGYRASAHQPEMVMVLKEVQPTNVLPPVSTSGMYYSVSSQPITETSVQVMETSLGMDTSLGLQSPSQTFCLPQTPEFSKSFSSRNTQTLESNPSPELGDISITPVQSPTNLLTLSPAPSQEKNENENLDEIKTNLSKPLDVHQILIGNQDPPLLPVEIPDIHPLLACIDPLGQEEQPGSENANLRNKSLSLEDQGIFENGIESSSDLADITTWVEDTYLPPIFSSLQDLDQPESPSAKKAKDTSAIKVNQVQEKSCVIKGHSDQVRKNKHKASEPIQGAPKAKIQPKNPECLLEREVVVGSATVSNSASVNKAKHSSNKPHKAASSRISKTKSHGQEKTKGNRKNSSKKSEESKQSGKKVKVEEKQTIPNMKRKKNQPELSQKTLKKPRSSLGMHMLESVQVFHALGKKIDMKTGFSSSRTLGSSSNTQNRQPFPALKPWLDIQHEGKGPEKIQVKAQKLDGSAEKECTSPSHSELPPPGKVKLIPLPFLTLDQPQARHVSRRPNPLASRRPAVAYPARPDSTNSAQSNAVNPSRPAPTNTSLTGPATPAQPISAKATQPSSANPTQPTVPQSAASRPSAYKTSSCSSLQREPVSTAVTSLRSLPKPQNQFLIQDFSLQPRPWRKPTVPEPVMSTPITEEQRPEREAMKRKAQQERENAAKYTSLGKVQFFIERERDMEIAEYYGYTI

SEQ ID NO: 16362 - protein, 193 aa, Homo sapiens
  Payload ID: 3267
  Gene Symbol: C2orf80
  Gene Name: chromosome 2 open reading frame 80
  Uniprot ID: Q0P641
  ENSP ID: ENSP00000343171
MERRLIKKEMKKLLGDYIGIRLRENEFDPKGRRQLTFLDDMAHYDLAISVALQWLDPSEDLTWLEWEELKIPLHGRPIYPNRREREAMILSSYAGILMNSIPIEEVFKIYGADSSADSGTIKVPRVSSLCLSLHPFAMLTAPKAAAYARKQSVKSRKVTTNKNATSISAKEANATEWKSSQRFSDTQPKHKVT

SEQ ID NO: 16363 - protein, 139 aa, Homo sapiens
  Payload ID: 3267
  Gene Symbol: C2orf80
  Gene Name: chromosome 2 open reading frame 80
  ENSP ID: ENSP00000389385
RPIYPNRREREAMILSSYAGILMNSIPIEEVFKIYGADSSADSGTIKVPRVSSLCLSLHPFAMLTAPKAAAYARKQIETGFHRGLDLLTSRSARLGLPKRWDYRLEPPRPAQLLGHLENWNCTMELHNRFSGSRREASS

SEQ ID NO: 16364 - protein, 124 aa, Homo sapiens
  Payload ID: 3267
  Gene Symbol: C2orf80
  Gene Name: chromosome 2 open reading frame 80
  ENSP ID: ENSP00000397144
MERRLIKKEMKKLLGDYIGIRLRENEFDPKGRRQLTFLDDMAHYDLAISVALQWLDPSEDLTWLEWEELKIPLHGRPIYPNRREREAMILSSYAGILMNSIPIEEVFKIYGADSSADSGTIKVT

SEQ ID NO: 16365 - protein, 66 aa, Homo sapiens
  Payload ID: 3267
  Gene Symbol: C2orf80
  Gene Name: chromosome 2 open reading frame 80
  ENSP ID: ENSP00000397281
MERRLIKKEMKKLLGDYIGIRLRENEFDPKGRRQLTFLDDMAHYDLAISVALQWLDPSEDLTWLEW

SEQ ID NO: 16366 - protein, 174 aa, Homo sapiens
  Payload ID: 3267
  Gene Symbol: C2orf80
  Gene Name: chromosome 2 open reading frame 80
  ENSP ID: ENSP00000405393
MRGCFSMPPEAEKEQKHWNRSPAHYDLAISVALQWLDPSEDLTWLEWEELKIPLHGRPIYPNRREREAMILSSYAGILMNSIPIEEVFKIYGADSSADSGTIKVPRVSSLCLSLHPFAMLTAPKAAAYARKQSVKSRKVTTNKNATSISAKEANATEWKSSQRFSDTQPKHKVT

SEQ ID NO: 16367 - protein, 128 aa, Homo sapiens
  Payload ID: 3267
  Gene Symbol: C2orf80
  Gene Name: chromosome 2 open reading frame 80
  ENSP ID: ENSP00000408378
  MOD_RES (1)..(1): Any amino acid
XVALQWLDPSEDLTWLEWEELKIPLHGRPIYPNRREREAMILSSYAGILMNSIPIEEVFKIYGADSSADSGTIKVPRVSSLCLSLHPFAMLTAPKAAAYARKQSHLENWNCTMELHNRFSGSRREASS

SEQ ID NO: 16368 - protein, 83 aa, Homo sapiens
  Payload ID: 3267
  Gene Symbol: C2orf80
  Gene Name: chromosome 2 open reading frame 80
  ENSP ID: ENSP00000413016
MILSSYAGILMNSIPIEEVFKIYGADSSADSGTIKVPRVSSLCLSLHPFAMLTAPKAAAYARKQSVKSRKVTTNKNATSISAK

SEQ ID NO: 16369 - protein, 588 aa, Homo sapiens
  Payload ID: 3268
  Gene Symbol: C2orf81
  Gene Name: chromosome 2 open reading frame 81
  ENSP ID: ENSP00000290390
MEMQSPIVQRQERQVRDRGVTRSKAEKVRPPTVPVPQVDIVPGRLSEAEWMALTALEEGEDVVGDILADLLARVMDSAFKVYLTQQCIPFTISQAREAMLQITEWRFLARDEGESAVAEDPTWGEDEEPSACTTDSWAQGSVPVLHASTSEGLENFQGEDPGGVDRIPLGRSWMGRGSQEQMESWEPSPQLRVTSAPPPTSELFQEAGPGGPVEEADGQSRGLSSAGSLSASFQLSVEEAPADDADPSLDPYLVASPQASTGRGHPLGFHLSLEDLYCCMPQLDAAGDRLELRSEGVPCIASGVLVSYPSVGGATRPSASCQQQRAGHSDVRLSAHHHRMRRKAAVKRLDPARLPCHWVRPLAEVLVPDSQTRPLEAYRGRQRGEKTKARAEPQALGPGTRVSPAAFFPLRPGIPFRDLDSGPALLFPTLNLGLSSPSLESKLPLPNSRIRFLTTHPVLPDVARSRSPKLWPSVRWPSGWEGKAELLGELWAGRTRVPPQGLELADREGQDPGRWPRTTPPVLEATSQVMWKPVLLPEALKLAPGVSMWNRSTQVLLSSGVPEQEDKEGSTFPPVEQHPIQTGAPKPR

SEQ ID NO: 16370 - protein, 161 aa, Homo sapiens
  Payload ID: 3268
  Gene Symbol: C2orf81
  Gene Name: chromosome 2 open reading frame 81
  ENSP ID: ENSP00000429388
MLQITEWRFLARDEGESAVAEDPTWGEDEEPSACTTDSWAQGSVPVLHASTSEGLENFQGEVHSSGASPDSSAIAPALPFPTSHCPSAFPQDPGGVDRIPLGRSWMGRGSQEQMESWEPSPQLRVTSAPPPTSELFQEAGPGGPVEEADGQSRGLSSAGSL

SEQ ID NO: 16371 - protein, 109 aa, Homo sapiens
  Payload ID: 3268
  Gene Symbol: C2orf81
  Gene Name: chromosome 2 open reading frame 81
  ENSP ID: ENSP00000430670
MSESSSKSSQPLASKQKKDGTEKRGRGRPRKQPPRQERQVRDRGVTRSKAEKVRPPTVPVPQVDIVPGRLSEAEWMALTALEEGEDVVGDILADLLARVMDSAFKVYLT

SEQ ID NO: 16372 - protein, 196 aa, Homo sapiens
  Payload ID: 3268
  Gene Symbol: C2orf81
  Gene Name: chromosome 2 open reading frame 81
  ENSP ID: ENSP00000430754
MEMQSPIVQRQERQVRDRGVTRSKAEKVRPPTVPVPQVDIVPGRLSEAEWMALTALEEGEDVVGDILADLLARVMDSAFKVYLTQQCIPFTISQAREAMLQITEWRFLARDEGESAVAEDPTWGEDEEPSACTTDSWAQGSVPVLHASTSEGLENFQGEVHSSGASPDSSAIAPALPFPTSHCPSAFPQDPGGVDR

SEQ ID NO: 16373 - protein, 520 aa, Homo sapiens
  Payload ID: 3268
  Gene Symbol: C2orf81
  Gene Name: chromosome 2 open reading frame 81
  ENSP ID: ENSP00000431103
MLQITEWRFLARDEGESAVAEDPTWGEDEEPSACTTDSWAQGSVPVLHASTSEGLENFQGEVHSSGASPDSSAIAPALPFPTSHCPSAFPQDPGGVDRIPLGRSWMGRGSQEQMESWEPSPQLRVTSAPPPTSELFQEAGPGGPVEEADGQSRGLSSAGSLSASFQLSVEEAPADDADPSLDPYLVASPQASTGRGHPLGFHLSLEDLYCCMPQLDAAGDRLELRSEGVPCIASGVLVSYPSVGGATRPSASCQQQRAGHSDVRLSAHHHRMRRKAAVKRLDPARLPCHWVRPLAEVLVPDSQTRPLEAYRGRQRGEKTKARAEPQALGPGTRVSPAAFFPLRPGIPFRDLDSGPALLFPTLNLGLSSPSLESKLPLPNSRIRFLTTHPVLPDVARSRSPKLWPSVRWPSGWEGKAELLGELWAGRTRVPPQGLELADREGQDPGRWPRTTPPVLEATSQVMWKPVLLPEALKLAPGVSMWNRSTQVLLSSGVPEQEDKEGSTFPPVEQHPIQTGAPKPR

SEQ ID NO: 16374 - protein, 582 aa, Homo sapiens
  Payload ID: 3268
  Gene Symbol: C2orf81
  Gene Name: chromosome 2 open reading frame 81
  ENSP ID: ENSP00000481409
MAHEGSRQVRDRGVTRSKAEKVRPPTVPVPQVDIVPGRLSEAEWMALTALEEGEDVVGDILADLLARVMDSAFKVYLTQQCIPFTISQAREAMLQITEWRFLARDEGESAVAEDPTWGEDEEPSACTTDSWAQGSVPVLHASTSEGLENFQGEDPGGVDRIPLGRSWMGRGSQEQMESWEPSPQLRVTSAPPPTSELFQEAGPGGPVEEADGQSRGLSSAGSLSASFQLSVEEAPADDADPSLDPYLVASPQASTGRGHPLGFHLSLEDLYCCMPQLDAAGDRLELRSEGVPCIASGVLVSYPSVGGATRPSASCQQQRAGHSDVRLSAHHHRMRRKAAVKRLDPARLPCHWVRPLAEVLVPDSQTRPLEAYRGRQRGEKTKARAEPQALGPGTRVSPAAFFPLRPGIPFRDLDSGPALLFPTLNLGLSSPSLESKLPLPNSRIRFLTTHPVLPDVARSRSPKLWPSVRWPSGWEGKAELLGELWAGRTRVPPQGLELADREGQDPGRWPRTTPPVLEATSQVMWKPVLLPEALKLAPGVSMWNRSTQVLLSSGVPEQEDKEGSTFPPVEQHPIQTGAPKPR

SEQ ID NO: 16375 - protein, 121 aa, Homo sapiens
  Payload ID: 3269
  Gene Symbol: C2orf82
  Gene Name: chromosome 2 open reading frame 82
  Uniprot ID: Q6UX34
  ENSP ID: ENSP00000333208
MASCLALRMALLLVSGVLAPAVLTDDVPQEPVPTLWNEPAELPSGEGPVESTSPGREPVDTGPPAPTVAPGPEDSTAQERLDQGGGSLGPGAIAAIVIAALLATCVVLALVVVALRKFSAS

SEQ ID NO: 16376 - protein, 121 aa, Homo sapiens; identical to SEQ ID NO: 16375
  Payload ID: 3269
  Gene Symbol: C2orf82
  Gene Name: chromosome 2 open reading frame 82
  Uniprot ID: Q6UX34
  ENSP ID: ENSP00000386804

SEQ ID NO: 16377 - protein, 121 aa, Homo sapiens; identical to SEQ ID NO: 16375
  Payload ID: 3269
  Gene Symbol: C2orf82
  Gene Name: chromosome 2 open reading frame 82
  Uniprot ID: Q6UX34
  ENSP ID: ENSP00000387130

SEQ ID NO: 16378 - protein, 19 aa, Homo sapiens
  Payload ID: 3269
  Gene Symbol: C2orf82
  Gene Name: chromosome 2 open reading frame 82
  ENSP ID: ENSP00000401100
MASCLALRMALLLVSGVLA

SEQ ID NO: 16379 - protein, 150 aa, Homo sapiens
  Payload ID: 3270
  Gene Symbol: C2orf83
  Gene Name: chromosome 2 open reading frame 83
  Uniprot ID: Q53S99
  ENSP ID: ENSP00000264387
MEDYALTFGINPFIALMIQPIVTMTVVDNQGLGLPVDIQHKAKPSPKASQMLPPDLGPPSFQNLLSPSEKLEPWDPGMRKLTVQTCGLTFIHPAGHGLCHPTAEASAETLSSTALNRPSVREGACNEKSTENKKPQDSVLWSHSRWFQGN

SEQ ID NO: 16380 - protein, 96 aa, Homo sapiens
  Payload ID: 3270
  Gene Symbol: C2orf83
  Gene Name: chromosome 2 open reading frame 83
  Uniprot ID: Q53S99
  ENSP ID: ENSP00000387149
MEDYALTFGINPFIALMIQPIVTMTVVDNQGLGLPVDIQHKAKPSPKASQMLPPDLGPPSFQNCFTCRTAPSLVMVLSWKSGVRREVPVHPSYAKY

SEQ ID NO: 16381 - protein, 95 aa, Homo sapiens
  Payload ID: 3271
  Gene Symbol: C2orf88
  Gene Name: chromosome 2 open reading frame 88
  Uniprot ID: Q9BSF0
  ENSP ID: ENSP00000345107
MGCMKSKQTFPFPTIYEGEKQHESEEPFMPEERCLPRMASPVNVKEEVKEPPGTNTVILEYAHRLSQDILCDALQQWACNNIKYHDIPYIESEGP

SEQ ID NO: 16382 - protein, 95 aa, Homo sapiens; identical to SEQ ID NO: 16381
  Payload ID: 3271
  Gene Symbol: C2orf88
  Gene Name: chromosome 2 open reading frame 88
  Uniprot ID: Q9BSF0
  ENSP ID: ENSP00000380172

SEQ ID NO: 16383 - protein, 95 aa, Homo sapiens; identical to SEQ ID NO: 16381
  Payload ID: 3271
  Gene Symbol: C2orf88
  Gene Name: chromosome 2 open reading frame 88
  Uniprot ID: Q9BSF0
  ENSP ID: ENSP00000386649

SEQ ID NO: 16384 - protein, 67 aa, Homo sapiens
  Payload ID: 3271
  Gene Symbol: C2orf88
  Gene Name: chromosome 2 open reading frame 88
  ENSP ID: ENSP00000386976
MGCMKSKQTFPFPTIYEGEKQHESEEPFMPEERCLPRMASPVNVKEEVKEPPGTNTVILEYAHRLSQ

SEQ ID NO: 16385 - protein, 30 aa, Homo sapiens
  Payload ID: 3271
  Gene Symbol: C2orf88
  Gene Name: chromosome 2 open reading frame 88
  ENSP ID: ENSP00000394370
MGCMKSKQTFPFPTIYEGEKQHESEEPFMP

SEQ ID NO: 16386 - protein, 95 aa, Homo sapiens; identical to SEQ ID NO: 16381
  Payload ID: 3271
  Gene Symbol: C2orf88
  Gene Name: chromosome 2 open reading frame 88
  Uniprot ID: Q9BSF0
  ENSP ID: ENSP00000405225

SEQ ID NO: 16387 - protein, 131 aa, Homo sapiens
  Payload ID: 3272
  Gene Symbol: C2orf91
  Gene Name: chromosome 2 open reading frame 91
  Uniprot ID: Q6ZV80
  ENSP ID: ENSP00000367983
MVRMSRPLFLDWAWRPLCSPSQSLPLTYGPEGWILQWKGTCRQQTALHCPFDFPQAPLRGRHTLSQVPNKGHEKASAVQLPEKQGTDQSRRGPTSAVTKARTSYPESETFIVYLCSYFWNSSKGVYMSGST

SEQ ID NO: 16388 - protein, 131 aa, Homo sapiens
  Payload ID: 3272
  Gene Symbol: C2orf91
  Gene Name: chromosome 2 open reading frame 91
  ENSP ID: ENSP00000479699
MVRMSRPLFLDWAWRPLCSPSQSLPLTYGPEGWILQWKGTCRQQTALHCPFDFPQAPLRGRHTLSQVPNKGHEKASAVQLPEKQGTDQSRRGPTSAVTKARTSYPESETFIVYLCSYFWNSSKGVYMSGKD

SEQ ID NO: 16389 - protein, 165 aa, Homo sapiens
  Payload ID: 3273
  Gene Symbol: C20orf141
  Gene Name: chromosome 20 open reading frame 141
  Uniprot ID: Q9NUB4
  ENSP ID: ENSP00000369963
MTRLCLPRPEAREDPIPVPPRGLGAGEGSGSPVRPPVSTWGPSWAQLLDSVLWLGALGLTIQAVFSTTGPALLLLLVSFLTFDLLHRPAGHTLPQRKLLTRGQSQGAGEGPGQQEALLLQMGTVSGQLSLQDALLLLLMGLGPLLRACGMPLTLLGLAFCLHPWA

SEQ ID NO: 16390 - protein, 165 aa, Homo sapiens; identical to SEQ ID NO: 16389
  Payload ID: 3273
  Gene Symbol: C20orf141
  Gene Name: chromosome 20 open reading frame 141
  Uniprot ID: Q9NUB4
  ENSP ID: ENSP00000473907

SEQ ID NO: 16391 - protein, 153 aa, Homo sapiens
  Payload ID: 3274
  Gene Symbol: C20orf144
  Gene Name: chromosome 20 open reading frame 144
  Uniprot ID: Q9BQM9
  ENSP ID: ENSP00000364370
MGNYSSHKRTKAPKQARKERPADMDKAWWKSFLNHLTRKKPATRIVLILPLDKRQPLANAGQRIDYASGAGLGSPAAPRLRGAGEGSEREPRMPVLLLLRRQEARRPEEGGARAALSWPRLLSRFRSPGKAPREAGPAEEQPRKRCRCPRPQL

SEQ ID NO: 16392 - protein, 149 aa, Homo sapiens
  Payload ID: 3275
  Gene Symbol: C20orf173
  Gene Name: chromosome 20 open reading frame 173
  Uniprot ID: Q96LM9
  ENSP ID: ENSP00000246199
MLSGPHPSPTFRPNPCPWPCLHSLWMEISPTQLCFLSPGPSPQSPSCCFQGMNSGSELGKLWRKLFKGIPRLSVSHFDFYCGTCVLLGRPQIPQGSSLGNDIDQYPVVFRNASDQGSWMQLEMLLRKLSDLVWTSDALSDKILEDGLVP

SEQ ID NO: 16393 - protein, 202 aa, Homo sapiens
  Payload ID: 3275
  Gene Symbol: C20orf173
  Gene Name: chromosome 20 open reading frame 173
  Uniprot ID: Q96LM9
  ENSP ID: ENSP00000363465
MKRWQIFVLWVFWVLILWLMTPYLDLTPESAPQEKRMYLVPQHCDCPWFSSGKCGCPSETLNCSSCHHTADEWNWLDACSRKTMGYLMRTRESMTSDTVLWWLGMNSGSELGKLWRKLFKGIPRLSVSHFDFYCGTCVLLGRPQIPQGSSLGNDIDQYPVVFRNASDQGSWMQLEMLLRKLSDLVWTSDALSDKILEDGLVP

SEQ ID NO: 16394 - protein, 65 aa, Homo sapiens
  Payload ID: 3275
  Gene Symbol: C20orf173
  Gene Name: chromosome 20 open reading frame 173
  ENSP ID: ENSP00000388785
MGYLMRTRESMTSDTVLWWLGMNSGSELGKLWRKLFKGIPRLSVSHFDFYCGTCVLLGRPQIPQG

SEQ ID NO: 16395 - protein, 202 aa, Homo sapiens; identical to SEQ ID NO: 16393
  Payload ID: 3275
  Gene Symbol: C20orf173
  Gene Name: chromosome 20 open reading frame 173
  Uniprot ID: Q96LM9
  ENSP ID: ENSP00000403566

SEQ ID NO: 16396 - protein, 1177 aa, Homo sapiens
  Payload ID: 3276
  Gene Symbol: C20orf194
  Gene Name: chromosome 20 open reading frame 194
  Uniprot ID: Q5TEA3
  ENSP ID: ENSP00000252032
MDVYPPRRQGLPRARSPGGSSRGSPSVSCSRLRQVQSILTQSSKSRPDGILCILGIDSRYNEGCRELANYLLFGLYNQNTSDFEKTGFSEEVLDDVIILIKSDSVHLYCNPVNFRYLLPYVAHWRNLHFHCMTENEYEDEEAAEEFKITSFVDMVRDCSRIGIPYSSQGHLQIFDMFVVEKWPIVQAFALEGIGGDGFFTMKYELQDVSLNLWNVYSKMDPMSLESLLSDDLVAFEHQWTSFFANFDTEIPFLLELSESQAGEPFRSYFSHGMISSHITENSPNRQPFVLFGNHSTRENLNAGNFNFPSEGHLVRSTGPGGSFAKHMVAQCVSPKGPLACSRTYFFGATHVPYLGGDSKLPKKTEQIRLLSQIYAAVIEAVLAGIACYAKTSSLTKAKEVAEQTLGSGLDSFELIPFKAALRSKMTFHIHAVNNQGRIVPLDSEDSLSFVKTACMAVYDIPDLLGGNGCLGSVVFSESFLTSQILVKEKDGTVTTETSSVVLTAAVPRFCSWLVEDNEVKLSEKTQQAVRGDESFLGTYLTGGEGAYLYSSNLQSWPEEGNVHFFSSGLLFSHCRHRSIIISKDHMNSISFYDGDSTSTVAALLIDFKSSLLPHLPVHFHGSSNFLMIALFPKSKIYQAFYSEVFSLWKQQDNSGISLKVIQEDGLSVEQKRLHSSAQKLFSALSQPAGEKRSSLKLLSAKLPELDWFLQHFAISSISQEPVMRTHLPVLLQQAEINTTHRIESDKVIISIVTGLPGCHASELCAFLVTLHKECGRWMVYRQIMDSSECFHAAHFQRYLSSALEAQQNRSARQSAYIRKKTRLLVVLQGYTDVIDVVQALQTHPDSNVKASFTIGAITACVEPMSCYMEHRFLFPKCLDQCSQGLVSNVVFTSHTTEQRHPLLVQLQSLIRAANPAAAFILAENGIVTRNEDIELILSENSFSSPEMLRSRYLMYPGWYEGKLNAGSVYPLMVQICVWFGRPLEKTRFVAKCKAIQSSIKPSPFSGNIYHILGKVKFSDSERTMEVCYNTLANSLSIMPVLEGPTPPPDSKSVSQDSSGQQECYLVFIGCSLKEDSIKDWLRQSAKQKPQRKALKTRGMLTQQEIRSIHVKRHLEPLPAGYFYNGTQFVNFFGDKTDFHPLMDQFMNDYVEEANREIEKYNQELEQQEYHDLFELKP

SEQ ID NO: 16397 - protein, 318 aa, Homo sapiens
  Payload ID: 3277
  Gene Symbol: C20orf195
  Gene Name: chromosome 20 open reading frame 195
  Uniprot ID: Q9BVV2
  ENSP ID: ENSP00000359115
MSTHVAGLGLDKMKLGNPQSFLDQEEADDQQLLEPEAWKTYTERRNALREFLTSDLSPHLLKRHHARMQLLRKCSYYIEVLPKHLALGDQNPLVLPSALFQLIDPWKFQRMKKVGTAQTKIQLLLLGDLLEQLDHGRAELDALLRSPDPRPFLADWALVERRLADVSAVMDSFLTMMVPGRLHVKHRLVSDVSATKIPHIWLMLSTKMPVVFDRKASAAHQDWARLRWFVTIQPATSEQYELRFRLLDPRTQQECAQCGVIPVAACTFDVRNLLPNRSYKFTIKRAETSTLVYEPWRDSLTLHTKPEPLEGPALSHSV

SEQ ID NO: 16398 - protein, 318 aa, Homo sapiens; identical to SEQ ID NO: 16397
  Payload ID: 3277
  Gene Symbol: C20orf195
  Gene Name: chromosome 20 open reading frame 195
  Uniprot ID: Q9BVV2
  ENSP ID: ENSP00000359116

SEQ ID NO: 16399 - protein, 318 aa, Homo sapiens; identical to SEQ ID NO: 16397
  Payload ID: 3277
  Gene Symbol: C20orf195
  Gene Name: chromosome 20 open reading frame 195
  Uniprot ID: Q9BVV2
  ENSP ID: ENSP00000480914

SEQ ID NO: 16400 - protein, 81 aa, Homo sapiens
  Payload ID: 3277
  Gene Symbol: C20orf195
  Gene Name: chromosome 20 open reading frame 195
  ENSP ID: ENSP00000483577
MSTHVAGLGLDKMKLGNPQSFLDQEEADDQQLLEPEAWKTYTERRNALREFLTSDLSPHLLKRHHARMQLLRKCSYYIEVL

SEQ ID NO: 16401 - protein, 205 aa, Homo sapiens
  Payload ID: 3278
  Gene Symbol: C20orf196
  Gene Name: chromosome 20 open reading frame 196
  Uniprot ID: Q8IYI0
  ENSP ID: ENSP00000305875
MAARDATSGSLSEESSALDLPSACDIRDYVLQGPSQEANSEAFSSLEFHSFPYSSDVDPDTSNLNIEQNNSWTAENFWLDPAVKGQSEKEEDDGLRKSLDRFYEMFGHPQPGSANSLSASVCKCLSQKITQLRGQESQKYALRSFQMARVIFNRDGCSVLQRHSRDTHFYPLEEGSTSLDDEKPNPGLSKDITHFLLQQNVMKDL

SEQ ID NO: 16402 - protein, 62 aa, Homo sapiens
  Payload ID: 3278
  Gene Symbol: C20orf196
  Gene Name: chromosome 20 open reading frame 196
  ENSP ID: ENSP00000368263
MAARDATSGSLSEESSALDLPSACDIRDYVLQGPSQEANSEAFSSLEFHSFPYSSDVDPADL

SEQ ID NO: 16403 - protein, 121 aa, Homo sapiens
  Payload ID: 3278
  Gene Symbol: C20orf196
  Gene Name: chromosome 20 open reading frame 196
  ENSP ID: ENSP00000399331
MAARDATSGSLSEESSALDLPSACDIRDYVLQGPSQEANSEAFSSLEFHSFPYSSDVDPDTSNLNIEQNNSWTAENFWLDPAVKGQSEKEEDDGLRKSLDRFYEMFGHPQPGSANSLSASV

SEQ ID NO: 16404 - protein, 200 aa, Homo sapiens
  Payload ID: 3278
  Gene Symbol: C20orf196
  Gene Name: chromosome 20 open reading frame 196
  ENSP ID: ENSP00000410534
MESHSCSPSWSTMTISAHCNLRLPSASQSVGITGVSHHIWPRIFYMTMAARDATSGSLSEESSALDLPSACDIRDYVLQGPSQEANSEAFSSLEFHSFPYSSDVDPDTSNLNIEQNNSWTAENFWLDPAVKGQSEKEEDDGLRKSLDRFYEMFGHPQPGSANSLSASVCKCLSQKITQLRGQESQKYALRSFQMARVIFN

SEQ ID NO: 16405 - protein, 122 aa, Homo sapiens
  Payload ID: 3279
  Gene Symbol: C20orf202
  Gene Name: chromosome 20 open reading frame 202
  Uniprot ID: A1L168
  ENSP ID: ENSP00000383474
MYKSKIPRAQNQVSVKVTPKNTEMKIAEEPSPSLGQTLEWLRKELSEMQIQDQSLLLTLRHLHSVLEELRADSAHWEDARSSGGTSPIRARAGSEGRGCQPVCSRGLAQLLRGEDSRRSSLP

SEQ ID NO: 16406 - protein, 129 aa, Homo sapiens
  Payload ID: 3280
  Gene Symbol: C20orf24
  Gene Name: chromosome 20 open reading frame 24
  Uniprot ID: Q9BUV8
  ENSP ID: ENSP00000340164
MSGGRRKEEPPQPQLANGALKVSVWSKVLRSDAAWEDKDEFLDVIYWFRQIIAVVLGVIWGVLPLRGFLGIAGFCLINAGVLYLYFSNYLQIDEEEYGGTWELTKEGFMTSFALFMVIWIIFYTAIHYD

SEQ ID NO: 16407 - protein, 143 aa, Homo sapiens
  Payload ID: 3280
  Gene Symbol: C20orf24
  Gene Name: chromosome 20 open reading frame 24
  Uniprot ID: Q9BUV8
  ENSP ID: ENSP00000341213
MSGGRRKEEPPQPQLANGALKVSVWSKVLRSDAAWEDKDEFLDVIYWFRQIIAVVLGVIWGVLPLRGFLGIAGSFGSSFTLPSIMTDGVQLPSAPYPVQRTLLITAQELDRWGTPAPWNLEDPCFLDRESVCWASVFSARVVT

SEQ ID NO: 16408 - protein, 137 aa, Homo sapiens
  Payload ID: 3280
  Gene Symbol: C20orf24
  Gene Name: chromosome 20 open reading frame 24
  Uniprot ID: Q9BUV8
  ENSP ID: ENSP00000362958
MSGGRRKEEPPQPQLANGALKVSVWSKVLRSDAAWEDKDEFLDVIYWFRQIIAVVLGVIWGVLPLRGFLGIAGFCLINAGVLYLYFSNYLQIDEEEYGGTWELTKEGFMTSFALFMVCVADSFTTGHLDHLLHCHPL

SEQ ID NO: 16409 - protein, 87 aa, Homo sapiens
  Payload ID: 3280
  Gene Symbol: C20orf24
  Gene Name: chromosome 20 open reading frame 24
  Uniprot ID: Q9BUV8
  ENSP ID: ENSP00000432510
MSGGRRKEEPPQPQLANGALKVSVWSKVLRSDAAWEDKDEFLDVIYWFRQIIAVVLGVIWGVLPLRGFLGIAGKGHCCSGAVCVCDD

SEQ ID NO: 16410 - protein, 87 aa, Homo sapiens; identical to SEQ ID NO: 16409
  Payload ID: 3280
  Gene Symbol: C20orf24
  Gene Name: chromosome 20 open reading frame 24
  Uniprot ID: Q9BUV8
  ENSP ID: ENSP00000435871

SEQ ID NO: 16411 - protein, 199 aa, Homo sapiens
  Payload ID: 3281
  Gene Symbol: C20orf27
  Gene Name: chromosome 20 open reading frame 27
  Uniprot ID: Q9GZN8
  ENSP ID: ENSP00000217195
MAAANKGKCLPGVVGLAQALPVGPGRRAIAAGNKPRVRSIRFAAGHDAEGSHSHVHFDEKLHDSVVMVTQESDSSFLVKVGFLKILHRYEITFTLPPVHRLSKDVREAPVPSLHLKLLSVVPVPEGYSVKCEYSAHKEGVLKEEILLACEGGTGTCVRVTVQARVMDRHHGTPMLLDGVKCVGAELEYDSEHSDWHGFD

SEQ ID NO: 16412 - protein, 174 aa, Homo sapiens
  Payload ID: 3281
  Gene Symbol: C20orf27
  Gene Name: chromosome 20 open reading frame 27
  Uniprot ID: Q9GZN8
  ENSP ID: ENSP00000369097
MAAANKGNKPRVRSIRFAAGHDAEGSHSHVHFDEKLHDSVVMVTQESDSSFLVKVGFLKILHRYEITFTLPPVHRLSKDVREAPVPSLHLKLLSVVPVPEGYSVKCEYSAHKEGVLKEEILLACEGGTGTCVRVTVQARVMDRHHGTPMLLDGVKCVGAELEYDSEHSDWHGFD

SEQ ID NO: 16413 - protein, 174 aa, Homo sapiens; identical to SEQ ID NO: 16412
  Payload ID: 3281
  Gene Symbol: C20orf27
  Gene Name: chromosome 20 open reading frame 27
  Uniprot ID: Q9GZN8
  ENSP ID: ENSP00000382580

SEQ ID NO: 16414 - protein, 127 aa, Homo sapiens
  Payload ID: 3281
  Gene Symbol: C20orf27
  Gene Name: chromosome 20 open reading frame 27
  ENSP ID: ENSP00000382591
  MOD_RES (1)..(1): Any amino acid
XNKPRVRSIRFAAGHDAEGSHSHVHFDEKLHDSVVMVTQESDSSFLVKVGFLKILHRYEITFTLPPVHRLSKDVREAPVPSLHLKLLSVVPVPEDRHHGTPMLLDGVKCVGAELEYDSEHSDWHGFD

SEQ ID NO: 16415 - protein, 137 aa, Homo sapiens
  Payload ID: 3282
  Gene Symbol: C20orf85
  Gene Name: chromosome 20 open reading frame 85
  Uniprot ID: Q9H1P6
  ENSP ID: ENSP00000360210
MAQKPLSTAAAERMNLVGQDEIWKYRLKAESEARQNWPQNWGFLTTPFEELIKCEEDLPTPKPKIELPERFRIRPVTPVEKYIKVFPSPPVPQTTQGFIGWRSAVPGLNKCLELDDAIRSCKGAFARELCWPKQGVH

SEQ ID NO: 16416 - protein, 363 aa, Homo sapiens
  Payload ID: 3283
  Gene Symbol: C20orf96
  Gene Name: chromosome 20 open reading frame 96
  Uniprot ID: Q9NUD7
  ENSP ID: ENSP00000353470
MAHVLQKPKHSGTHSIVQEFQVPDYVPWQQSKQETKPSTLPPVQQANSLHTSKMKTLTRVQPVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREIIDQFEENMPVLRAEVEELQAQTREPREVIFEDVLLRRPKCTPDMDVILNIPVEEPLPF

SEQ ID NO: 16417 - protein, 328 aa, Homo sapiens
  Payload ID: 3283
  Gene Symbol: C20orf96
  Gene Name: chromosome 20 open reading frame 96
  ENSP ID: ENSP00000371806
MEVLSLPNSFQTQALWDSLHSPGVPGSVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREIIDQFEENMPVLRAEVEELQAQTREPREVIFEDVLLRRPKCTPDMDVILNIPVEEPLPF

SEQ ID NO: 16418 - protein, 362 aa, Homo sapiens
  Payload ID: 3283
  Gene Symbol: C20orf96
  Gene Name: chromosome 20 open reading frame 96
  ENSP ID: ENSP00000383128
MSYKSRPKHSGTHSIVQEFQVPDYVPWQQSKQETKPSTLPPVQQANSLHTSKMKTLTRVQPVFHFKPTTVVTSCQPKNPRELHRRRKLDPGKMHAKIWLMKTSLRSGRAALRELRSRENFLSKLNRELIETIQEMENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREIIDQFEENMPVLRAEVEELQAQTREPREVIFEDVLLRRPKCTPDMDVILNIPVEEPLPF

SEQ ID NO: 16419 - protein, 251 aa, Homo sapiens
  Payload ID: 3284
  Gene Symbol: C21orf140
  Gene Name: chromosome 21 open reading frame 140
  Uniprot ID: B9A014
  ENSP ID: ENSP00000386791
MPRFASPLLRNVIIRSQFDGIKRKQCLQYLKTLRTLQYDGFKTVYFGETNIPESLVTGEDISDGYFIQTPTWCIVHAAGSQGWVPWKYRVFLRDELCIKQEDSLFSEFCDVVRKAYGKCVIVVKERRQQEEQRPKEDREAEGQFYIPTVISLASIMCCPEVAKSCGHELLSLPSPCNYLNPLDSAWSSLKWFIINNRNEFCLQSIDSGYSYQCILFSNLISKGIERINASKWRTLTSKVRRWENYYLGKFS

SEQ ID NO: 16420 - protein, 255 aa, Homo sapiens
  Payload ID: 3285
  Gene Symbol: C21orf2
  Gene Name: chromosome 21 open reading frame 2
  Uniprot ID: O43822
  ENSP ID: ENSP00000317302
MKLTRKMVLTRAKASELHSVRKLNCWGSRLTDISICQEMPSLEVITLSVNSISTLEPVSRCQRLSELYLRRNRIPSLAELFYLKGLPRLRVLWLAENPCCGTSPHRYRMTVLRTLPRLQKLDNQAVTEEELSRALSEGEEITAAPEREGTGHGGPKLCCTLSSLSSAAETGRDPLDSEEEATGAQDERGLKPPSRGQFPSLSARDASSSHRGRNVLTAILLLLRELDAEGLEAVQQTVGSRLQALRGEEVQEHAE

SEQ ID NO: 16421 - protein, 256 aa, Homo sapiens
  Payload ID: 3285
  Gene Symbol: C21orf2
  Gene Name: chromosome 21 open reading frame 2
  Uniprot ID: O43822
  ENSP ID: ENSP00000344566
MKLTRKMVLTRAKASELHSVRKLNCWGSRLTDISICQEMPSLEVITLSVNSISTLEPVSRCQRLSELYLRRNRIPSLAELFYLKGLPRLRVLWLAENPCCGTSPHRYRMTVLRTLPRLQKLDNQAVTEEELSRALSEGEEITAAPEREGTGHGGPKLCCTLSSLSSAAETGRDPLDSEEEATSGAQDERGLKPPSRGQFPSLSARDASSSHRGRNVLTAILLLLRELDAEGLEAVQQTVGSRLQALRGEEVQEHAE

SEQ ID NO: 16422 - protein, 375 aa, Homo sapiens
  Payload ID: 3285
  Gene Symbol: C21orf2
  Gene Name: chromosome 21 open reading frame 2
  Uniprot ID: O43822
  ENSP ID: ENSP00000381047
MKLTRKMVLTRAKASELHSVRKLNCWGSRLTDISICQEMPSLEVITLSVNSISTLEPVSRCQRLSELYLRRNRIPSLAELFYLKGLPRLRVLWLAENPCCGTSPHRYRMTVLRTLPRLQKLDNQAVTEEELSRALSEGEEITAAPEREGTGHGGPKLCCTLSSLSSAAETGRDPLDSEEEATGAQDERGLKPPSRGQFPSLSARDASSSHRGRVSGGPLGAAAASAHCTHCTETVGREHGASQGPVGREHGASQGLEELCPRGSCVCGSVNAHTRVTRAPHGAVLAPQPLLLSWSVECGPGPCWAEGNRSHVEEVPHTRPQAGLLCSDSPSVPNVLTAILLLLRELDAEGLEAVQQTVGSRLQALRGEEVQEHAE

SEQ ID NO: 16423 - protein, 268 aa, Homo sapiens
  Payload ID: 3286
  Gene Symbol: C21orf33
  Gene Name: chromosome 21 open reading frame 33
  Uniprot ID: P30042
  ENSP ID: ENSP00000291577
MAAVRVLVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 16424 - protein, 237 aa, Homo sapiens
  Payload ID: 3286
  Gene Symbol: C21orf33
  Gene Name: chromosome 21 open reading frame 33
  Uniprot ID: P30042
  ENSP ID: ENSP00000344901
MAAVRVLVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 16425 - protein, 224 aa, Homo sapiens; identical to SEQ ID NO: 1061
  Payload ID: 3286
  Gene Symbol: C21orf33
  Gene Name: chromosome 21 open reading frame 33
  ENSP ID: ENSP00000374340

SEQ ID NO: 16426 - protein, 217 aa, Homo sapiens
  Payload ID: 3286
  Gene Symbol: C21orf33
  Gene Name: chromosome 21 open reading frame 33
  ENSP ID: ENSP00000396655
MAAVRVLVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGCDASTSLPAPAPWWSWNAALCCPGLSCVWCWQGESRTCVGEHQ

SEQ ID NO: 16427 - protein, 257 aa, Homo sapiens
  Payload ID: 3286
  Gene Symbol: C21orf33
  Gene Name: chromosome 21 open reading frame 33
  ENSP ID: ENSP00000400044
  MOD_RES (1)..(1): Any amino acid
XRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLCVFELQGLPLSMWSRWEGGAPVCCPMWSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 16428 - protein, 191 aa, Homo sapiens
  Payload ID: 3286
  Gene Symbol: C21orf33
  Gene Name: chromosome 21 open reading frame 33
  ENSP ID: ENSP00000405713
  MOD_RES (1)..(1): Any amino acid
XQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMEEREIAAPQPPGLTSGE

SEQ ID NO: 16429 - protein, 322 aa, Homo sapiens
  Payload ID: 3287
  Gene Symbol: C21orf58
  Gene Name: chromosome 21 open reading frame 58
  Uniprot ID: P58505
  ENSP ID: ENSP00000291691
MARSRLPATSLRKPWKLDRQKLPSPDSGHSLLCGWSPGGKARPAGNTGAWAPAEQFFPASNRTREGGGLWPPLPLQSSPAAPTMLDSSAAEQVTRLTLKLLGQKLEQERQNVEGGPEGLHLEPGNEDRPDDALQTALKRRRDLLQRLREQHLLDELSRAQAWSGPSRGALGSALPPELPPTGILPTASPSPLAPDPPRIILPTVPQPPATIIQQLPQQPLIAQIPPPQAFPTQRSGSIKEDMVELLLLQNAQVHQLVLQNWMLKALPPALQDPPHVPPRVPRAARPRLPAVHHHHHHHHAVWPPGAATVLQPAPSLWTPGPP

SEQ ID NO: 16430 - protein, 216 aa, Homo sapiens
  Payload ID: 3287
  Gene Symbol: C21orf58
  Gene Name: chromosome 21 open reading frame 58
  ENSP ID: ENSP00000380796
MAILPGEAPVPGPGWPEPDAGGASVALGLPVPVCSSSASALQEQHLLDELSRAQAWSGPSRGALGSALPPELPPTGILPTASPSPLAPDPPRIILPTVPQPPATIIQQLPQQPLIAQIPPPQAFPTQRSGSIKEDMVELLLLQNAQVHQLVLQNWMLKALPPALQDPPHVPPRVPRAARPRLPAVHHHHHHHHAVWPPGAATVLQPAPSLWTPGPP

SEQ ID NO: 16431 - protein, 216 aa, Homo sapiens; identical to SEQ ID NO: 16430
  Payload ID: 3287
  Gene Symbol: C21orf58
  Gene Name: chromosome 21 open reading frame 58
  ENSP ID: ENSP00000380797

SEQ ID NO: 16432 - protein, 216 aa, Homo sapiens; identical to SEQ ID NO: 16430
  Payload ID: 3287
  Gene Symbol: C21orf58
  Gene Name: chromosome 21 open reading frame 58
  ENSP ID: ENSP00000380798

SEQ ID NO: 16433 - protein, 216 aa, Homo sapiens; identical to SEQ ID NO: 16430
  Payload ID: 3287
  Gene Symbol: C21orf58
  Gene Name: chromosome 21 open reading frame 58
  ENSP ID: ENSP00000380799

SEQ ID NO: 16434 - protein, 45 aa, Homo sapiens
  Payload ID: 3287
  Gene Symbol: C21orf58
  Gene Name: chromosome 21 open reading frame 58
  ENSP ID: ENSP00000390432
MAILPGEAPVPGPGWPEPDAGGASVALGLPVPVCSSSASALQEQH

SEQ ID NO: 16435 - protein, 284 aa, Homo sapiens
  Payload ID: 3287
  Gene Symbol: C21orf58
  Gene Name: chromosome 21 open reading frame 58
  ENSP ID: ENSP00000402356
GKARPAGNTGAWAPAEQFFPASNRTREGGGLWPPLPLQSSPAAPTMLDSSAAEQVTRLTLKLLGQKLEQERQNVEGGPEGLHLEPGNEDRPDDALQTALKRRRDLLQRLREQHLLDELSRAQAWSGPSRGALGSALPPELPPTGILPTASPSPLAPDPPRIILPTVPQPPATIIQQLPQQPLIAQIPPPQAFPTQRSGSIKEDMVELLLLQNAQVHQLVLQNWMLKALPPALQDPPHVPPRVPRAARPRLPAVHHHHHHHHAVWPPGAATVLQPAPSLWTPGPP

SEQ ID NO: 16436 - protein, 239 aa, Homo sapiens
  Payload ID: 3287
  Gene Symbol: C21orf58
  Gene Name: chromosome 21 open reading frame 58
  ENSP ID: ENSP00000431312
GKARPAGNTGAWAPAEQFFPASNRTREGGGLWPPLPLQSSPAAPTMLDSSAAEQVTRLTLKLLGQKLEQERQNVEGGPEGLHLEPGNEDRPDDALQTALKRRRDLLQRLREQHLLDELSRAQAWSGPSRGALGSALPPELPPTGILPTASPSPLAPDPPRIILPTVPQPPATIIQQLPQQPLIAQIPPPQAFPTQRSGSIKEDMVELLLLQNAQVHQLVLQNWMLKALPPALQDRFFHS

SEQ ID NO: 16437 - protein, 290 aa, Homo sapiens
  Payload ID: 3288
  Gene Symbol: C21orf59
  Gene Name: chromosome 21 open reading frame 59
  Uniprot ID: P57076
  ENSP ID: ENSP00000290155
MVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQRGQGAPAREPIISSEEQKQLMLYYHRRQEELKRLEENDDDAYLNSPWADNTALKRHFHGVKDIKWRPR

SEQ ID NO: 16438 - protein, 138 aa, Homo sapiens
  Payload ID: 3288
  Gene Symbol: C21orf59
  Gene Name: chromosome 21 open reading frame 59
  ENSP ID: ENSP00000300260
MVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQETSGSRCLCYHGDGERCLGPASRRGDDCLPHGVATV

SEQ ID NO: 16439 - protein, 245 aa, Homo sapiens
  Payload ID: 3288
  Gene Symbol: C21orf59
  Gene Name: chromosome 21 open reading frame 59
  ENSP ID: ENSP00000371989
MVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQVSTFCFNVSVVFVISLQTDKNVQ

SEQ ID NO: 16440 - protein, 183 aa, Homo sapiens
  Payload ID: 3288
  Gene Symbol: C21orf59
  Gene Name: chromosome 21 open reading frame 59
  ENSP ID: ENSP00000393104
MVLLHVKRGDESQFLLQAPGSTELEELTVQVARVYNGRLKVQRLCSGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRR

SEQ ID NO: 16441 - protein, 117 aa, Homo sapiens
  Payload ID: 3288
  Gene Symbol: C21orf59
  Gene Name: chromosome 21 open reading frame 59
  ENSP ID: ENSP00000407362
  MOD_RES (1)..(1): Any amino acid
XYPMGLPPYDPIRMEFENKEDLSGTQAGLNVIKEAEAQLWWAAKELRRTKKLSDYVGKNEKTKIIAKIQQRGQGAPAREPIISSEEQKQLMLYYHRRQEELKVAGDRWAFCSAGAHT

SEQ ID NO: 16442 - protein, 79 aa, Homo sapiens
  Payload ID: 3288
  Gene Symbol: C21orf59
  Gene Name: chromosome 21 open reading frame 59
  ENSP ID: ENSP00000411306
  MOD_RES (1)..(1): Any amino acid
XLRRTKKLSDYVGKNEKTKIIAKIQQIFATFQVVVLCPPELGPRSLGPLDQNPNQLRNRLLADEPGGSGARDAVSNVAP

SEQ ID NO: 16443 - protein, 258 aa, Homo sapiens
  Payload ID: 3288
  Gene Symbol: C21orf59
  Gene Name: chromosome 21 open reading frame 59
  ENSP ID: ENSP00000411467
MVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQRLEENDDDAYLNSPWADNTALKRHFHGVKDIKWRPR

SEQ ID NO: 16444 - protein, 266 aa, Homo sapiens
  Payload ID: 3289
  Gene Symbol: C21orf62
  Gene Name: chromosome 21 open reading frame 62
  ENSP ID: ENSP00000371810
CRLNQLSSQGEGSVARQRSVEWRGEASRWNSQMTACRHQESGRTYRRQPCTELGTCNNNSTLGVFALNCFTKGQKNSTLIFTRENTIRNCSCSADIRDCDYSLANLMCNCKTVLPLAVERTSYNGHLTIWFTDTSALGHLLNFTLVQDLKLSLCSTNTLPTEYLAICGLKRLRINMEAKHPFPEQSLLIHSGGDSDSREKPMWLHKGWQPCMYISFLDMALFNRDSALKSYSIENVTSIANNFPDFSYFRTFPMPSNKSYVVTFIY

SEQ ID NO: 16445 - protein, 219 aa, Homo sapiens
  Payload ID: 3289
  Gene Symbol: C21orf62
  Gene Name: chromosome 21 open reading frame 62
  Uniprot ID: Q9NYP8
  ENSP ID: ENSP00000418511
MAPPSRHCLLLISTLGVFALNCFTKGQKNSTLIFTRENTIRNCSCSADIRDCDYSLANLMCNCKTVLPLAVERTSYNGHLTIWFTDTSALGHLLNFTLVQDLKLSLCSTNTLPTEYLAICGLKRLRINMEAKHPFPEQSLLIHSGGDSDSREKPMWLHKGWQPCMYISFLDMALFNRDSALKSYSIENVTSIANNFPDFSYFRTFPMPSNKSYVVTFIY

SEQ ID NO: 16446 - protein, 219 aa, Homo sapiens; identical to SEQ ID NO: 16445
  Payload ID: 3289
  Gene Symbol: C21orf62
  Gene Name: chromosome 21 open reading frame 62
  Uniprot ID: Q9NYP8
  ENSP ID: ENSP00000418653

SEQ ID NO: 16447 - protein, 219 aa, Homo sapiens; identical to SEQ ID NO: 16445
  Payload ID: 3289
  Gene Symbol: C21orf62
  Gene Name: chromosome 21 open reading frame 62
  Uniprot ID: Q9NYP8
  ENSP ID: ENSP00000418830

SEQ ID NO: 16448 - protein, 219 aa, Homo sapiens; identical to SEQ ID NO: 16445
  Payload ID: 3289
  Gene Symbol: C21orf62
  Gene Name: chromosome 21 open reading frame 62
  Uniprot ID: Q9NYP8
  ENSP ID: ENSP00000444950

SEQ ID NO: 16449 - protein, 219 aa, Homo sapiens; identical to SEQ ID NO: 16445
  Payload ID: 3289
  Gene Symbol: C21orf62
  Gene Name: chromosome 21 open reading frame 62
  Uniprot ID: Q9NYP8
  ENSP ID: ENSP00000460629

SEQ ID NO: 16450 - protein, 266 aa, Homo sapiens; identical to SEQ ID NO: 16444
  Payload ID: 3289
  Gene Symbol: C21orf62
  Gene Name: chromosome 21 open reading frame 62
  ENSP ID: ENSP00000461325

SEQ ID NO: 16451 - protein, 219 aa, Homo sapiens; identical to SEQ ID NO: 16445
  Payload ID: 3289
  Gene Symbol: C21orf62
  Gene Name: chromosome 21 open reading frame 62
  Uniprot ID: Q9NYP8
  ENSP ID: ENSP00000461359

SEQ ID NO: 16452 - protein, 219 aa, Homo sapiens; identical to SEQ ID NO: 16445
  Payload ID: 3289
  Gene Symbol: C21orf62
  Gene Name: chromosome 21 open reading frame 62
  Uniprot ID: Q9NYP8
  ENSP ID: ENSP00000461558

SEQ ID NO: 16453 - protein, 219 aa, Homo sapiens; identical to SEQ ID NO: 16445
  Payload ID: 3289
  Gene Symbol: C21orf62
  Gene Name: chromosome 21 open reading frame 62
  Uniprot ID: Q9NYP8
  ENSP ID: ENSP00000479857

SEQ ID NO: 16454 - protein, 297 aa, Homo sapiens
  Payload ID: 3290
  Gene Symbol: C21orf91
  Gene Name: chromosome 21 open reading frame 91
  Uniprot ID: Q9NYK6
  ENSP ID: ENSP00000284881
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREELNSMTLGEVEQLNAKLLQQIQEVFEELTHQVQEKDSLASQLHVRHVAIEQLLKNCSKLPCLQVGRTGMKSHLPINN

SEQ ID NO: 16455 - protein, 221 aa, Homo sapiens
  Payload ID: 3290
  Gene Symbol: C21orf91
  Gene Name: chromosome 21 open reading frame 91
  Uniprot ID: Q9NYK6
  ENSP ID: ENSP00000383403
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREE

SEQ ID NO: 16456 - protein, 296 aa, Homo sapiens
  Payload ID: 3290
  Gene Symbol: C21orf91
  Gene Name: chromosome 21 open reading frame 91
  Uniprot ID: Q9NYK6
  ENSP ID: ENSP00000383404
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREELNSMTLGEVEQLNAKLLQQIQVFEELTHQVQEKDSLASQLHVRHVAIEQLLKNCSKLPCLQVGRTGMKSHLPINN

SEQ ID NO: 16457 - protein, 242 aa, Homo sapiens
  Payload ID: 3290
  Gene Symbol: C21orf91
  Gene Name: chromosome 21 open reading frame 91
  ENSP ID: ENSP00000385566
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREELNSMTLGEVEQLNAKLLQQIQ

SEQ ID NO: 16458 - protein, 157 aa, Homo sapiens
  Payload ID: 3291
  Gene Symbol: C22orf15
  Gene Name: chromosome 22 open reading frame 15
  ENSP ID: ENSP00000305096
MFIKVMFGAGCSVLVNTSCRLVNLTAHLRQKAGLPPDATIALLAEDGNLVSLEEDLKEGASRAQTMGNSLLKERAIYVLVRIISKRERTWPPPAMSPYWRTWMTITQSWQRNCAGCQASPLWATTGGSVWALGEAAMSKAPLQGPERALIKGMDCTL

SEQ ID NO: 16459 - protein, 142 aa, Homo sapiens
  Payload ID: 3291
  Gene Symbol: C22orf15
  Gene Name: chromosome 22 open reading frame 15
  Uniprot ID: Q8WYQ4
  ENSP ID: ENSP00000372271
MFIKVMFGAGCSVLVNTSCRLVNLTAHLRQKAGLPPDATIALLAEDGNLVSLEEDLKEGASRAQTMGNSLLKERAIYVLVRIISKVAQEGEDMASTRYESLLENLDDHYPELAGANRQQPSRTPLAESGIAEKLHQQEGQGP

SEQ ID NO: 16460 - protein, 148 aa, Homo sapiens
  Payload ID: 3291
  Gene Symbol: C22orf15
  Gene Name: chromosome 22 open reading frame 15
  Uniprot ID: Q8WYQ4
  ENSP ID: ENSP00000384965
MFIKVMFGAGCSVLVNTSCRLVNLTAHLRQKAGLPPDATIALLAEDGNLVSLEEDLKEGASRAQTMGNSLLKERAIYVLVRIIKGEDMASTRYESLLENLDDHYPELAEELRRLSGLSSVGHNWRKRMGTRRGRHEQSPTSRPRKGPD

SEQ ID NO: 16461 - protein, 132 aa, Homo sapiens
  Payload ID: 3291
  Gene Symbol: C22orf15
  Gene Name: chromosome 22 open reading frame 15
  ENSP ID: ENSP00000478052
MLCSQPGLANSSRVRGRVGTIRPVRCPSSSLHMSQRERTWPPPAMSPYWRTWMTITQSWQVSVRVQPRGRAHLLPNPYQQDFLGLPEELRRLSGLSSVGHNWRKRMGTRRGRHEQSPTSRPRKVSSLPPRSC

SEQ ID NO: 16462 - protein, 134 aa, Homo sapiens
  Payload ID: 3291
  Gene Symbol: C22orf15
  Gene Name: chromosome 22 open reading frame 15
  ENSP ID: ENSP00000486337
  MOD_RES (1)..(1): Any amino acid
XGCSVLVNTSCRLVNLTAHLRQKAGLPPDATIALLAEDGNLVSLEEDLKEGASRAQTMGNSLLKERAIYVLVRIISKVAQEGEDMASTRYESLLENLDDHYPELAGANRQQPSRTPLAESGIAEKLHQQEGQGP

SEQ ID NO: 16463 - protein, 149 aa, Homo sapiens
  Payload ID: 3291
  Gene Symbol: C22orf15
  Gene Name: chromosome 22 open reading frame 15
  ENSP ID: ENSP00000486344
  MOD_RES (1)..(1): Any amino acid
XGCSVLVNTSCRLVNLTAHLRQKAGLPPDATIALLAEDGNLVSLEEDLKEGASRAQTMGNSLLKERAIYVLVRIISKRERTWPPPAMSPYWRTWMTITQSWQRNCAGCQASPLWATTGGSVWALGEAAMSKAPLQGPERALIKGMDCTL

SEQ ID NO: 16464 - protein, 140 aa, Homo sapiens
  Payload ID: 3291
  Gene Symbol: C22orf15
  Gene Name: chromosome 22 open reading frame 15
  ENSP ID: ENSP00000486389
  MOD_RES (1)..(1): Any amino acid
XGCSVLVNTSCRLVNLTAHLRQKAGLPPDATIALLAEDGNLVSLEEDLKEGASRAQTMGNSLLKERAIYVLVRIIKGEDMASTRYESLLENLDDHYPELAEELRRLSGLSSVGHNWRKRMGTRRGRHEQSPTSRPRKGPD

SEQ ID NO: 16465 - protein, 217 aa, Homo sapiens
  Payload ID: 3292
  Gene Symbol: C22orf23
  Gene Name: chromosome 22 open reading frame 23
  Uniprot ID: Q9BZE7
  ENSP ID: ENSP00000249079
MASQKQMEVVTKGTGFRRRPKTITYTPGTCELLRVMMKESKLTNIQQRHIMDIMKRGDALPLQCSPTSSQRVLPSKQIASPIYLPPILAARPHLRPANMCQANGAYSREQFKPQATRDLEKEKQRLQNIFATGKDMEERKRKAPPARQKAPAPELDRFEELVKEIQERKEFLADMEALGQGKQYRGIILAEISQKLREMEDIDHRRSEELRKGLATT

SEQ ID NO: 16466 - protein, 217 aa, Homo sapiens; identical to SEQ ID NO: 16465
  Payload ID: 3292
  Gene Symbol: C22orf23
  Gene Name: chromosome 22 open reading frame 23
  Uniprot ID: Q9BZE7
  ENSP ID: ENSP00000384618

SEQ ID NO: 16467 - protein, 217 aa, Homo sapiens; identical to SEQ ID NO: 16465
  Payload ID: 3292
  Gene Symbol: C22orf23
  Gene Name: chromosome 22 open reading frame 23
  Uniprot ID: Q9BZE7
  ENSP ID: ENSP00000384667

SEQ ID NO: 16468 - protein, 162 aa, Homo sapiens
  Payload ID: 3292
  Gene Symbol: C22orf23
  Gene Name: chromosome 22 open reading frame 23
  ENSP ID: ENSP00000395077
MASQKQMEVVTKGTGFRRRPKTITYTPGTCELLRVMMKESKLTNIQQRHIMDIMKRGDALPLQCSPTSSQRVLPSKQIASPIYLPPILAARPHLRPANMCQANGAYSREQFKPQATRDLEKEKQRLQNIFATGKDMEERKRKAPPARQKAPAPELDRFEELV

SEQ ID NO: 16469 - protein, 120 aa, Homo sapiens
  Payload ID: 3292
  Gene Symbol: C22orf23
  Gene Name: chromosome 22 open reading frame 23
  ENSP ID: ENSP00000407707
MASQKQMEVVTKGTGFRRRPKTITYTPGTCELLRVMMKESKLTNIQQRHIMDIMKRGDALPLQCSPTSSQRVLPSKQIASPIYLPPILAARPHLRPANMCQANGAYSREQFKPQATRDLE

SEQ ID NO: 16470 - protein, 196 aa, Homo sapiens
  Payload ID: 3292
  Gene Symbol: C22orf23
  Gene Name: chromosome 22 open reading frame 23
  ENSP ID: ENSP00000483445
MASQKQMEVVTKGTGFRRRPKTITYTPGTCELLRGGDALPLQCSPTSSQRVLPSKQIASPIYLPPILAARPHLRPANMCQANGAYSREQFKPQATRDLEKEKQRLQNIFATGKDMEERKRKAPPARQKAPAPELDRFEELVKEIQERKEFLADMEALGQGKQYRGIILAEISQKLREMEDIDHRRSEELRKGLATT

SEQ ID NO: 16471 - protein, 364 aa, Homo sapiens
  Payload ID: 3293
  Gene Symbol: C22orf29
  Gene Name: chromosome 22 open reading frame 29
  Uniprot ID: Q7L3V2
  ENSP ID: ENSP00000330596
MPRGRCRQQGPRIPIWAAANYANAHPWQQMDKASPGVAYTPLVDPWIERPCCGDTVCVRTTMEQKSTASGTCGGKPAERGPLAGHMPSSRPHRVDFCWVPGSDPGTFDGSPWLLDRFLAQLGDYMSFHFEHYQDNISRVCEILRRLTGRAQAWAAPYLDGDLPLPDDYELFCQDLKEVVQDPNSFAEYHAVVTCPLPLASSQLPVAPQLPVVRQYLARFLEGLALDMGTAPRSLPAAMATPAVSGSNSVSRSALFEQQLTKESTPGPKEPPVLPSSTCSSKPGPVEPASSQPEEAAPTPVPRLSESANPPAQRPDPAHPGGPKPQKTEEEVLETEGDQEVSLGTPQEVVEAPETPGEPPLSPGF

SEQ ID NO: 16472 - protein, 364 aa, Homo sapiens; identical to SEQ ID NO: 16471
  Payload ID: 3293
  Gene Symbol: C22orf29
  Gene Name: chromosome 22 open reading frame 29
  Uniprot ID: Q7L3V2
  ENSP ID: ENSP00000384924

SEQ ID NO: 16473 - protein, 364 aa, Homo sapiens; identical to SEQ ID NO: 16471
  Payload ID: 3293
  Gene Symbol: C22orf29
  Gene Name: chromosome 22 open reading frame 29
  Uniprot ID: Q7L3V2
  ENSP ID: ENSP00000386111

SEQ ID NO: 16474 - protein, 91 aa, Homo sapiens
  Payload ID: 3293
  Gene Symbol: C22orf29
  Gene Name: chromosome 22 open reading frame 29
  ENSP ID: ENSP00000392994
MPRGRCRQQGPRIPIWAAANYANAHPWQQMDKASPGVAYTPLVDPWIERPCCGDTVCVRTTMEQKSTASGTCGGKPAERGPLAGHMPSSRP

SEQ ID NO: 16475 - protein, 290 aa, Homo sapiens
  Payload ID: 3294
  Gene Symbol: C22orf31
  Gene Name: chromosome 22 open reading frame 31
  Uniprot ID: O95567
  ENSP ID: ENSP00000216071
MHPINVRRDPSIPIYGLRQSILLNTRLQDCYVDSPALTNIWMARTCAKQNINAPAPATTSSWEVVRNPLIASSFSLVKLVLRRQLKNKCCPPPCKFGEGKLSKRLKHKDDSVMKATQQARKRNFISSKSKQPAGHRRPAGGIRESKESSKEKKLTVRQDLEDRYAEHVAATQALPQDSGTAAWKGRVLLPETQKRQQLSEDTLTIHGLPTEGYQALYHAVVEPMLWNPSGTPKRYSLELGKAIKQKLWEALCSQGAISEGAQRDRFPGRKQPGVHEEPVLKKWPKLKSKK

SEQ ID NO: 16476 - protein, 105 aa, Homo sapiens
  Payload ID: 3295
  Gene Symbol: C22orf39
  Gene Name: chromosome 22 open reading frame 39
  ENSP ID: ENSP00000333064
MADGSGWQPPRPCEAYRAEWKLCRSARHFLHHYYVHGERPACEQWQRDLASCRDWEERRNAEAQQSLCESERARVRAARKHILVWAPRQSPPPDWHLPLPQEKDE

SEQ ID NO: 16477 - protein, 142 aa, Homo sapiens
  Payload ID: 3295
  Gene Symbol: C22orf39
  Gene Name: chromosome 22 open reading frame 39
  Uniprot ID: Q6P5X5
  ENSP ID: ENSP00000382474
MCRCSLVLLSVDHEVPFSSFFIGWRTEGRAWRAGRPDMADGSGWQPPRPCEAYRAEWKLCRSARHFLHHYYVHGERPACEQWQRDLASCRDWEERRNAEAQQSLCESERARVRAARKHILVWAPRQSPPPDWHLPLPQEKDE

SEQ ID NO: 16478 - protein, 80 aa, Homo sapiens
  Payload ID: 3295
  Gene Symbol: C22orf39
  Gene Name: chromosome 22 open reading frame 39
  ENSP ID: ENSP00000382478
MADGSGWQPPRPCEAYRAEWKLCRSARHFLHHYYVHGERPACEQWQRDLASCRDWEERRNAEAQVLSVVAHTCNLSYLGG

SEQ ID NO: 16479 - protein, 92 aa, Homo sapiens
  Payload ID: 3295
  Gene Symbol: C22orf39
  Gene Name: chromosome 22 open reading frame 39
  ENSP ID: ENSP00000424903
MADGSGWQPPRPCEAYRAEWKLCRSARHFLHHYYVHGERPACEQWQRDLASCRDWEERRNAEAQASRFFQLIFTLTGPSSQLEDKGRILGRL

SEQ ID NO: 16480 - protein, 117 aa, Homo sapiens
  Payload ID: 3295
  Gene Symbol: C22orf39
  Gene Name: chromosome 22 open reading frame 39
  Uniprot ID: Q6P5X5
  ENSP ID: ENSP00000439212
MCRCSLVLLSVDHEVPFSSFFIGWRTEGRAWRAGRPDMADGSGWQPPRPCEAYRAEWKLCRSARHFLHHYYVHGERPACEQWQRDLASCRDWEERRNAEAQVLSVVAHTCNLSYLGG

SEQ ID NO: 16481 - protein, 142 aa, Homo sapiens; identical to SEQ ID NO: 16477
  Payload ID: 3295
  Gene Symbol: C22orf39
  Gene Name: chromosome 22 open reading frame 39
  Uniprot ID: Q6P5X5
  ENSP ID: ENSP00000479673

SEQ ID NO: 16482 - protein, 251 aa, Homo sapiens
  Payload ID: 3296
  Gene Symbol: C22orf42
  Gene Name: chromosome 22 open reading frame 42
  Uniprot ID: Q6IC83
  ENSP ID: ENSP00000371529
MGSKLTCCLGPSGGLNCDCCRPDVGPCHECEIPETVAATAPASTTAKPAKLDLKAKKAQLMQYLSLPKTPKMLKMSKGLDARSKRWLKIIWRRHGIWPLENIGPTEDVQASAHGGVEENMTSDIEIPEAKHDHRPTEDVQVSAHGGVEENITSDIEISEAKHDHHLVEDLSESLSVCLEDFMTSDLSESLSVSLEDFMTSGLSESLSVSLEDLMTPEMAKERYEDYLCWVKMARSRLNEPISSQVLGLLRL

SEQ ID NO: 16483 - protein, 243 aa, Homo sapiens
  Payload ID: 3297
  Gene Symbol: C22orf46
  Gene Name: chromosome 22 open reading frame 46
  Uniprot ID: C9J442
  ENSP ID: ENSP00000385467
MLLSLLGACAVVGPFHGPEWEPVQGLLSQNHSCRDPQCCGNLLVLCLFLVWQVRHCWHQVTRTRFSTRNVIKVPLQKRAVPSMRCETVFKLTPEFFSPGKSRGLDSQQCAQRQRWGYRRSLQESWAQNLLSPQHPCPGPPSGVHTHSEPIFCTTSISNTCLLPQNSSWKAWQVPWCLHDGQTRPALDMCQEMEQLLLHSQERLVSLEPVISVRSRPTSMTLTTSLPNLLSAERLQFCPQRAPA

SEQ ID NO: 16484 - protein, 128 aa, Homo sapiens
  Payload ID: 3298
  Gene Symbol: C3orf14
  Gene Name: chromosome 3 open reading frame 14
  Uniprot ID: Q9HBI5
  ENSP ID: ENSP00000232519
MTSLFAQEIRLSKRHEEIVSQRLMLLQQMENKLGDQHTEKASQLQTVETAFKRNLSLLKDIEAAEKSLQTRIHPLPRPEVVSLETRYWASVEEYIPKWEQFLLGRAPYPFAVENQNEAENTIQNEAQR

SEQ ID NO: 16485 - protein, 128 aa, Homo sapiens; identical to SEQ ID NO: 16484
  Payload ID: 3298
  Gene Symbol: C3orf14
  Gene Name: chromosome 3 open reading frame 14
  Uniprot ID: Q9HBI5
  ENSP ID: ENSP00000418086

SEQ ID NO: 16486 - protein, 62 aa, Homo sapiens
  Payload ID: 3298
  Gene Symbol: C3orf14
  Gene Name: chromosome 3 open reading frame 14
  ENSP ID: ENSP00000419937
MTSLFAQEIRLSKRHEEIVSQRLMLLQQMENKLGDQHTEKASQLQTVETAFKRNLSLLKDIE

SEQ ID NO: 16487 - protein, 128 aa, Homo sapiens; identical to SEQ ID NO: 16484
  Payload ID: 3298
  Gene Symbol: C3orf14
  Gene Name: chromosome 3 open reading frame 14
  Uniprot ID: Q9HBI5
  ENSP ID: ENSP00000419977

SEQ ID NO: 16488 - protein, 128 aa, Homo sapiens; identical to SEQ ID NO: 16484
  Payload ID: 3298
  Gene Symbol: C3orf14
  Gene Name: chromosome 3 open reading frame 14
  Uniprot ID: Q9HBI5
  ENSP ID: ENSP00000438275

SEQ ID NO: 16489 - protein, 567 aa, Homo sapiens
  Payload ID: 3299
  Gene Symbol: C3orf17
  Gene Name: chromosome 3 open reading frame 17
  Uniprot ID: Q6NW34
  ENSP ID: ENSP00000320251
MMAAVPPGLEPWNRVRIPKAGNRSAVTVQNPGAALDLCIAAVIKECHLVILSLKSQTLDAETDVLCAVLYSNHNRMGRHKPHLALKQVEQCLKRLKNMNLEGSIQDLFELFSSNENQPLTTKVCVVPSQPVVELVLMKVLGACKLLLRLLDCCCKTFLLTVKHLGLQEFIILNLVMVGLVSRLWVLYKGVLKRLILLYEPLFGLLQEVARIQPMPYFKDFTFPSDITEFLGQPYFEAFKKKMPIAFAAKGINKLLNKLFLINEQSPRASEETLLGISKKAKQMKINVQNNVDLGQPVKNKRVFKEESSEFDVRAFCNQLKHKATQETSFDFKCSQSRLKTTKYSSQKVIGTPHAKSFVQRFREAESFTQLSEEIQMAVVWCRSKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 16490 - protein, 497 aa, Homo sapiens
  Payload ID: 3299
  Gene Symbol: C3orf17
  Gene Name: chromosome 3 open reading frame 17
  Uniprot ID: Q6NW34
  ENSP ID: ENSP00000373173
MMAAVPPGLEPWNRVRIPKAGNRSAVTVQNPGAALDLCIAAVIKECHLVILSLKSQTLDAETDVLCAVLYSNHNRMGRHKPHLALKQVEQCLKRLKNMNLEGSIQDLFELFSSKVLYKGVLKRLILLYEPLFGLLQEVARIQPMPYFKDFTFPSDITEFLGQPYFEAFKKKMPIAFAAKGINKLLNKLFLINEQSPRASEETLLGISKKAKQMKINVQNNVDLGQPVKNKRVFKEESSEFDVRAFCNQLKHKATQETSFDFKCSQSRLKTTKYSSQKVIGTPHAKSFVQRFREAESFTQLSEEIQMAVVWCRSKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 16491 - protein, 81 aa, Homo sapiens
  Payload ID: 3299
  Gene Symbol: C3orf17
  Gene Name: chromosome 3 open reading frame 17
  ENSP ID: ENSP00000417613
MGRHKPHLALKQVEQCLKRLKNMNLEGSIQDLFELFSSNENQPLTTKVCVVPSQPVVELVLMKVLGACKLLLRLLDCCCKT

SEQ ID NO: 16492 - protein, 36 aa, Homo sapiens
  Payload ID: 3299
  Gene Symbol: C3orf17
  Gene Name: chromosome 3 open reading frame 17
  ENSP ID: ENSP00000417734
MMAAVPPGLEPWNRVRIPKAGNRSAVTVQNPGAALG

SEQ ID NO: 16493 - protein, 36 aa, Homo sapiens; identical to SEQ ID NO: 16492
  Payload ID: 3299
  Gene Symbol: C3orf17
  Gene Name: chromosome 3 open reading frame 17
  ENSP ID: ENSP00000417968

SEQ ID NO: 16494 - protein, 36 aa, Homo sapiens; identical to SEQ ID NO: 16492
  Payload ID: 3299
  Gene Symbol: C3orf17
  Gene Name: chromosome 3 open reading frame 17
  ENSP ID: ENSP00000417983

SEQ ID NO: 16495 - protein, 114 aa, Homo sapiens
  Payload ID: 3299
  Gene Symbol: C3orf17
  Gene Name: chromosome 3 open reading frame 17
  ENSP ID: ENSP00000418133
MMAAVPPGLEPWNRVRIPKAGNRSAVTVQNPGAALDLCIAAVIKECHLVILSLKSQTLDAETDVLCAVLYSNHNRMGRHKPHLALKQVEQCLKRLKNMNLEGSIQDLFELFSSK

SEQ ID NO: 16496 - protein, 238 aa, Homo sapiens
  Payload ID: 3299
  Gene Symbol: C3orf17
  Gene Name: chromosome 3 open reading frame 17
  ENSP ID: ENSP00000418309
MMAAVPPGLEPWNRVRIPKAGNRSAVTVQNPGAALDLCIAAVIKECHLVILSLKSQTLDAETDVLCAVLYSNHNRMGRHKPHLALKQVEQCLKRLKNMNLEGSIQDLFELFSSKVLYKGVLKRLILLYEPLFGLLQEVARIQPMPYFKDFTFPSDITEFLGQPYFEAFKKKMPIAFAAKGINKLLNKLFLINEQSPRASEETLLGISKKAKQMKINVQNNVDLGQPVKNKRVFKGDQF

SEQ ID NO: 16497 - protein, 39 aa, Homo sapiens
  Payload ID: 3299
  Gene Symbol: C3orf17
  Gene Name: chromosome 3 open reading frame 17
  ENSP ID: ENSP00000418677
MMAAVPPGLEPWNRVRIPKAGNRSAVTVQNPGAALGDQF

SEQ ID NO: 16498 - protein, 36 aa, Homo sapiens; identical to SEQ ID NO: 16492
  Payload ID: 3299
  Gene Symbol: C3orf17
  Gene Name: chromosome 3 open reading frame 17
  ENSP ID: ENSP00000418902

SEQ ID NO: 16499 - protein, 36 aa, Homo sapiens; identical to SEQ ID NO: 16492
  Payload ID: 3299
  Gene Symbol: C3orf17
  Gene Name: chromosome 3 open reading frame 17
  ENSP ID: ENSP00000419174

SEQ ID NO: 16500 - protein, 36 aa, Homo sapiens; identical to SEQ ID NO: 16492
  Payload ID: 3299
  Gene Symbol: C3orf17
  Gene Name: chromosome 3 open reading frame 17
  ENSP ID: ENSP00000419462

SEQ ID NO: 16501 - protein, 36 aa, Homo sapiens; identical to SEQ ID NO: 16492
  Payload ID: 3299
  Gene Symbol: C3orf17
  Gene Name: chromosome 3 open reading frame 17
  ENSP ID: ENSP00000419716

SEQ ID NO: 16502 - protein, 113 aa, Homo sapiens
  Payload ID: 3299
  Gene Symbol: C3orf17
  Gene Name: chromosome 3 open reading frame 17
  ENSP ID: ENSP00000420036
MAAVPPGLEPWNRVRIPKAGNRSAVTVQNPGAALDLCIAAVIKECHLVILSLKSQTLDAETDVLCAVLYSNHNRMGRHKPHLALKQVEQCLKRLKNMNLEGSIQDLFELFSSK

SEQ ID NO: 16503 - protein, 36 aa, Homo sapiens; identical to SEQ ID NO: 16492
  Payload ID: 3299
  Gene Symbol: C3orf17
  Gene Name: chromosome 3 open reading frame 17
  ENSP ID: ENSP00000420471

SEQ ID NO: 16504 - protein, 36 aa, Homo sapiens; identical to SEQ ID NO: 16492
  Payload ID: 3299
  Gene Symbol: C3orf17
  Gene Name: chromosome 3 open reading frame 17
  ENSP ID: ENSP00000420505

SEQ ID NO: 16505 - protein, 36 aa, Homo sapiens; identical to SEQ ID NO: 16492
  Payload ID: 3299
  Gene Symbol: C3orf17
  Gene Name: chromosome 3 open reading frame 17
  ENSP ID: ENSP00000420577

SEQ ID NO: 16506 - protein, 162 aa, Homo sapiens
  Payload ID: 3300
  Gene Symbol: C3orf18
  Gene Name: chromosome 3 open reading frame 18
  Uniprot ID: Q9UK00
  ENSP ID: ENSP00000349732
MNSRTASARGWFSSRPPTSESDLEPATDGPASETTTLSPEATTFNDTRIPDAAGGTAGVGTMLLSFGIITVIGLAVALVLYIRKKKRLEKLRHQLMPMYNFDPTEEQDELEQELLEHGRDAASVQAATSVQAMQGKTTLPSQGPLQRPSRLVFTDVANAIHA

SEQ ID NO: 16507 - protein, 162 aa, Homo sapiens; identical to SEQ ID NO: 16506
  Payload ID: 3300
  Gene Symbol: C3orf18
  Gene Name: chromosome 3 open reading frame 18
  Uniprot ID: Q9UK00
  ENSP ID: ENSP00000387606

SEQ ID NO: 16508 - protein, 110 aa, Homo sapiens
  Payload ID: 3300
  Gene Symbol: C3orf18
  Gene Name: chromosome 3 open reading frame 18
  ENSP ID: ENSP00000399129
MSPSRRAAGFLRASSPCHLMLLLLLQVLYIRKKKRLEKLRHQLMPMYNFDPTEEQDELEQELLEHGRDAASVQAATSVQAMQGKTTLPSQGPLQRPSRLVFTDVANAIHA

SEQ ID NO: 16509 - protein, 104 aa, Homo sapiens
  Payload ID: 3300
  Gene Symbol: C3orf18
  Gene Name: chromosome 3 open reading frame 18
  ENSP ID: ENSP00000400599
MNSRTASARGWFSSRPPTSESDLEPATDGPASETTTLSPEATTFNDTRIPDAAGGTAGVGTMLLSFGIITVIGLAVALRRGVSMLPRLDLNSWAQEILLPQPLE

SEQ ID NO: 16510 - protein, 162 aa, Homo sapiens; identical to SEQ ID NO: 16506
  Payload ID: 3300
  Gene Symbol: C3orf18
  Gene Name: chromosome 3 open reading frame 18
  Uniprot ID: Q9UK00
  ENSP ID: ENSP00000404913

SEQ ID NO: 16511 - protein, 142 aa, Homo sapiens
  Payload ID: 3300
  Gene Symbol: C3orf18
  Gene Name: chromosome 3 open reading frame 18
  Uniprot ID: Q9UK00
  ENSP ID: ENSP00000414124
MNSRTASARGWFSSRPPTSESDLEPATDGPASETTTLSPEATTFNDTRIPDAAGGTAGVLYIRKKKRLEKLRHQLMPMYNFDPTEEQDELEQELLEHGRDAASVQAATSVQAMQGKTTLPSQGPLQRPSRLVFTDVANAIHA

SEQ ID NO: 16512 - protein, 904 aa, Homo sapiens
  Payload ID: 3301
  Gene Symbol: C3orf20
  Gene Name: chromosome 3 open reading frame 20
  Uniprot ID: Q8ND61
  ENSP ID: ENSP00000253697
MSYIKSNLELYQQYTAMAPKLLARISKLLMICQNAGISVPKGIRNIFEFTWEELISDPSVPTPSDILGLEVSFGAPLVVLMEPTFVQVPTLKKPLPPPPPAPPRPVLLATTGAAKRSTLSPTMARQVRTHQETLNRFQQQSIHLLTELLRLKMKAMVESMSVGANPLDITRRFVEASQLLHLNAKEMAFNCLISTAGRSGYSSGQLWKESLANMSAIGVNSPYQLIYHSSTACLSFSLSAGKEAKKKIGKSRTTEDVSMPPLHRGVGTPANSLEFSDPCPEAREKLQELCRHIEAERATWKGRNISYPMILRNYKAKMPSHLMLARKGDSQTPGLHYPPTAGAQTLSPTSHPSSANHHFSQHCQEGKAPKKAFKFHYTFYDGSSFVYYPSGNVAVCQIPTCCRGRTITCLFNDIPGFSLLALFNTEGQGCVHYNLKTSCPYVLILDEEGGTTNDQQGYVVHKWSWTSRTETLLSLEYKVNEEMKLKVLGQDSITVTFTSLNETVTLTVSANNCPHGMAYDKRLNRRISNMDDKVYKMSRALAEIKKRFQKTVTQFINSILLAAGLFTIEYPTKKEEEEFVRFKMRSRTHPERLPKLSLYSGESLLRSQSGHLESSIAETLKDEPESAPVSPVRKTTKIHTKAKVTSRGKAREGRSPTRWAALPSDCPLVLRKLMLKEDTRAGCKCLVKAPLVSDVELERFLLAPRDPSQVLVFGIISSQNYTSTGQLQWLLNTLYNHQQRGRGSPCIQCRYDSYRLLQYDLDSPLQEDPPLMVKKNSVVQGMILMFAGGKLIFGGRVLNGYGLSKQNLLKQIFRSQQDYKMGYFLPDDYKFSVPNSVLSLEDSESVKKAESEDIQGSSSSLALEDYVEKELSLEAEKTREPEVELHPLSRDSKITSWKKQASKK

SEQ ID NO: 16513 - protein, 782 aa, Homo sapiens
  Payload ID: 3301
  Gene Symbol: C3orf20
  Gene Name: chromosome 3 open reading frame 20
  Uniprot ID: Q8ND61
  ENSP ID: ENSP00000396081
MARQVRTHQETLNRFQQQSIHLLTELLRLKMKAMVESMSVGANPLDITRRFVEASQLLHLNAKEMAFNCLISTAGRSGYSSGQLWKESLANMSAIGVNSPYQLIYHSSTACLSFSLSAGKEAKKKIGKSRTTEDVSMPPLHRGVGTPANSLEFSDPCPEAREKLQELCRHIEAERATWKGRNISYPMILRNYKAKMPSHLMLARKGDSQTPGLHYPPTAGAQTLSPTSHPSSANHHFSQHCQEGKAPKKAFKFHYTFYDGSSFVYYPSGNVAVCQIPTCCRGRTITCLFNDIPGFSLLALFNTEGQGCVHYNLKTSCPYVLILDEEGGTTNDQQGYVVHKWSWTSRTETLLSLEYKVNEEMKLKVLGQDSITVTFTSLNETVTLTVSANNCPHGMAYDKRLNRRISNMDDKVYKMSRALAEIKKRFQKTVTQFINSILLAAGLFTIEYPTKKEEEEFVRFKMRSRTHPERLPKLSLYSGESLLRSQSGHLESSIAETLKDEPESAPVSPVRKTTKIHTKAKVTSRGKAREGRSPTRWAALPSDCPLVLRKLMLKEDTRAGCKCLVKAPLVSDVELERFLLAPRDPSQVLVFGIISSQNYTSTGQLQWLLNTLYNHQQRGRGSPCIQCRYDSYRLLQYDLDSPLQEDPPLMVKKNSVVQGMILMFAGGKLIFGGRVLNGYGLSKQNLLKQIFRSQQDYKMGYFLPDDYKFSVPNSVLSLEDSESVKKAESEDIQGSSSSLALEDYVEKELSLEAEKTREPEVELHPLSRDSKITSWKKQASKK

SEQ ID NO: 16514 - protein, 782 aa, Homo sapiens; identical to SEQ ID NO: 16513
  Payload ID: 3301
  Gene Symbol: C3orf20
  Gene Name: chromosome 3 open reading frame 20
  Uniprot ID: Q8ND61
  ENSP ID: ENSP00000402933

SEQ ID NO: 16515 - protein, 141 aa, Homo sapiens
  Payload ID: 3302
  Gene Symbol: C3orf22
  Gene Name: chromosome 3 open reading frame 22
  Uniprot ID: Q8N5N4
  ENSP ID: ENSP00000316644
MDSSACKKSHQSKKWRIQAQENFAKKFPYRLSWLTEPDPEPLQPWEVTNDSNTVQLPLQKRLVPTRSIPVRGLGAPDFTSPSGSCPAPLPAPSPPPLCNLWELKLLSRRFPRQLAFLLSTRHTEAACPQTSKAAGLSRGLS

SEQ ID NO: 16516 - protein, 102 aa, Homo sapiens
  Payload ID: 3302
  Gene Symbol: C3orf22
  Gene Name: chromosome 3 open reading frame 22
  Uniprot ID: Q8N5N4
  ENSP ID: ENSP00000422064
MDSSACKKSHQSKKWRIQAQENFAKKFPYRLSWLTEPDPEPLQPWEVTNDSNTVQLPLQKRLVPTRSIPVRGVGVRIKKSMNVTSRTLSQMYTHTGKWAPFH

SEQ ID NO: 16517 - protein, 536 aa, Homo sapiens
  Payload ID: 3303
  Gene Symbol: C3orf30
  Gene Name: chromosome 3 open reading frame 30
  Uniprot ID: Q96M34
  ENSP ID: ENSP00000295622
MEEPPQEALAEPLKHESPAAPSSAGHTKGQEEDDQKNQAERKADNHTAHRIADQTALRVPSQAESSIFSQATNGVAEQNGHSTPGQAGRRASNPADVSDLRADDQVNQTPSEQTKGKASSQANNVQHEQSDGQVSGLTEERTAEQTERRLPTQAERRTSGQIDGRLAMPSDQRGSRQTDHRMAGQSERRASEQMDRRMSGEAERRTSEQITHRLSKLSERRPSVQIDSGSSVPSDQSPSVQIDSGSSVPSDQRPSVQIDRRMSGKVRRRSSEKTDYRLAGLADPGTSEQTDLRLYGLVDHKTSVKTHHQVYGQATELAEHQAIDQAHSNADQPPVDNAHYTESDQTDHLADRQANHKDQLSYYETRGQSEDRIFPQLGNSKEDKEADYRVQPCKFEDSQVDLNSKPSVEMETQNATTIPPYNPVDARFTSNFQAKDQALFPRLPSISSKLNYTSSQEKTQAIVTKSDEFSEIDQGKGYHIRNQTYRRFPSIVYEDPYQVSLQYMEKHHILQIFQQITENLVYEKPEDPLNFMLCQV

SEQ ID NO: 16518 - protein, 441 aa, Homo sapiens
  Payload ID: 3303
  Gene Symbol: C3orf30
  Gene Name: chromosome 3 open reading frame 30
  ENSP ID: ENSP00000418207
  MOD_RES (1)..(1): Any amino acid
XQAERKADNHTAHRIADQTALRVPSQAESSIFSQATNGVAEQNGHSTPGQAGRRASNPADVSDLRADDQVNQTPSEQTKGKASSQANNVQHEQSDGQVSGLTEERTAEQTERRLPTQAERRTSGQIDGRLAMPSDQRGSRQTDHRMAGQSERRASEQMDRRMSGEAERRTSEQITHRLSKLSERRPSVQIDSGSSVPSDQSPSVQIDSGSSVPSDQRPSVQIDRRMSGKVRRRSSEKTDYRLAGLADPGTSEQTDLRLYGLVDHKTSVKTHHQVYGQATELAEHQAIDQAHSNADQPPVDNAHYTESDQTDHLADRQANHKDQLSYYETRGQSEDRIFPQLGNSKEDKEADYRVQPCKFEDSQVDLNSKPSVEMETQNATTIPPYNPVDARFTSNFQAKDQALFPRLPSISSKLNYTSSQEKTQAIVTKSVQEMMKKRDKM

SEQ ID NO: 16519 - protein, 222 aa, Homo sapiens
  Payload ID: 3303
  Gene Symbol: C3orf30
  Gene Name: chromosome 3 open reading frame 30
  ENSP ID: ENSP00000419083
  MOD_RES (1)..(1): Any amino acid
XRRRSSEKTDYRLAGLADPGTSEQTDLRLYGLVDHKTSVKTHHQVYGQATELAEHQAIDQAHSNADQPPVDNAHYTESDQTDHLADRQANHKDQLSYYETRGQSEDRIFPQLGNSKEDKEADYRVQPCKFEDSQVDLNSKPSVEMETQNATTIPPYNPVDARFTSNFQAKDQALFPRLPSISSKLNYTSSQEKTQAIVTKSITENLVYEKPEDPLNFMLCQV

SEQ ID NO: 16520 - protein, 287 aa, Homo sapiens
  Payload ID: 3303
  Gene Symbol: C3orf30
  Gene Name: chromosome 3 open reading frame 30
  ENSP ID: ENSP00000419675
  MOD_RES (1)..(1): Any amino acid
XQITHRLSKLSERRPSVQIDSGSSVPSDQSPSVQIDSGSSVPSDQRPSVQIDRRMSGKVRRRSSEKTDYRLAGLADPGTSEQTDLRLYGLVDHKTSVKTHHQVYGQATELAEHQAIDQAHSNADQPPVDNAHYTESDQTDHLADRQANHKDQLSYYETRGQSEDRIFPQLGNSKEDKEADYRVQPCKFEDSQVDLNSKPSVEMETQNATTIPPYNPVDARFTSNFQAKDQALFPRLPSISSKLNYTSSQEKTQAIVTKSFMKILTKFHSNTWKNTTFCKYSSRLLKT

SEQ ID NO: 16521 - protein, 535 aa, Homo sapiens
  Payload ID: 3303
  Gene Symbol: C3orf30
  Gene Name: chromosome 3 open reading frame 30
  ENSP ID: ENSP00000474929
MEEPPQEALAEPLKHESPAAPSSAGHTKGQEEDDQKNQAERKADNHTAHRIADQTALRVPSQAESSIFSQATNGVAEQNGHSTPGQAGRRASNPADVSDLRADDQVNQTPSEQTKGKASSQANNVQHEQSDGQVSGLTEERTAEQTERRLPTQAERRTSGQIDGRLAMPSDQRGSRQTDHRMAGQSERRASEQMDRRMSGEAERRTSEQITHRLSKLSERRPSVQIDSGSSVPSDQSPSVQIDSGSSVPSDQRPSVQIDRRMSGKVRRRSSEKTDYRLAGLADPGTSEQTDLRLYGLVDHKTSVKTHHQVYGQATELAEHQAIDQAHSNADQPPVDNAHYTESDQTDHLADRQANHKDQLSYYETRGQSEDRIFPQLGNSKEDKEADYRVQPCKFEDSQVDLNSKPSVEMETQNATTIPPYNPVDARFTSNFQAKDQALFPRLPSISSKLNYTSSQEKTQAIVTKSDEFSEIDQGKGYHIRNQTYRRFPSIVYEDPYQVSLQYMEKHHILQIFQITENLVYEKPEDPLNFMLCQV

SEQ ID NO: 16522 - protein, 294 aa, Homo sapiens
  Payload ID: 3304
  Gene Symbol: C3orf33
  Gene Name: chromosome 3 open reading frame 33
  Uniprot ID: Q6P1S2
  ENSP ID: ENSP00000342512
MAGQPAATGSPSADKDGMEPNVVARISQWADDHLRLVRNISTGMAIAGIMLLLRSIRLTSKFTSSSDIPVEFIRRNVKLRGRLRRITENGLEIEHIPITLPIIASLRKEPRGALLVKLAGVELAETGKAWLQKELKPSQLLWFQLLGKENSALFCYLLVSKGGYFSVNLNEEILRRGLGKTVLVKGLKYDSKIYWTVHRNLLKAELTALKKGEGIWKEDSEKESYLEKFKDSWREIWKKDSFLKTTGSDFSLKKESYYEKLKRTYEIWKDNMNNCSLILKFRELISRINFRRKG

SEQ ID NO: 16523 - protein, 115 aa, Homo sapiens
  Payload ID: 3304
  Gene Symbol: C3orf33
  Gene Name: chromosome 3 open reading frame 33
  ENSP ID: ENSP00000417361
  MOD_RES (1)..(1): Any amino acid
XAGQPAATGSPSADKDGMEPNVVARISQWADDHLRLVRGHGIPLWPKLECSGTIIAHCCCSTHFGRKDPPTSASRVAGTTDQVLHLSPRLECNGVISAHCNLCLPGSSDCPASPS

SEQ ID NO: 16524 - protein, 119 aa, Homo sapiens
  Payload ID: 3304
  Gene Symbol: C3orf33
  Gene Name: chromosome 3 open reading frame 33
  ENSP ID: ENSP00000418410
MAGQPAATGSPSADKDGMEPNVVARISQWADDHLRLVRGHGIPLWPKLECSGTIIAHCCCSTHFGRKDPPTSASRVAGTTEHQHWNGHSWNNVTFEKHSTDIKIYKLFGYSSRIYKKKC

SEQ ID NO: 16525 - protein, 71 aa, Homo sapiens
  Payload ID: 3304
  Gene Symbol: C3orf33
  Gene Name: chromosome 3 open reading frame 33
  ENSP ID: ENSP00000420246
MAGQPAATGSPSADKDGMEPNVVARISQWADDHLRLVRNISTGMAIAGIMLLLRSIRLKSHVVLCWLSWLE

SEQ ID NO: 16526 - protein, 251 aa, Homo sapiens
  Payload ID: 3304
  Gene Symbol: C3orf33
  Gene Name: chromosome 3 open reading frame 33
  Uniprot ID: Q6P1S2
  ENSP ID: ENSP00000445446
MAIAGIMLLLRSIRLTSKFTSSSDIPVEFIRRNVKLRGRLRRITENGLEIEHIPITLPIIASLRKEPRGALLVKLAGVELAETGKAWLQKELKPSQLLWFQLLGKENSALFCYLLVSKGGYFSVNLNEEILRRGLGKTVLVKGLKYDSKIYWTVHRNLLKAELTALKKGEGIWKEDSEKESYLEKFKDSWREIWKKDSFLKTTGSDFSLKKESYYEKLKRTYEIWKDNMNNCSLILKFRELISRINFRRKG

SEQ ID NO: 16527 - protein, 165 aa, Homo sapiens
  Payload ID: 3305
  Gene Symbol: C3orf36
  Gene Name: chromosome 3 open reading frame 36
  Uniprot ID: Q3SXR2
  ENSP ID: ENSP00000386219
MQAETILEGLEAGLPQAVSSGLSLVPAPGLVLTCLSAPSGPGGMALEPPPTTLRKAFLAQSTLLESTLEGAPEWAAPHPEEQRRSPPACSQHTPPLPSTPTGPPPCSPGGNHPLCALSGRGGGRCSIPSLSSSSTFSLFSSGCWNPRVKLRVRKSQSQGRAGQLI

SEQ ID NO: 16528 - protein, 329 aa, Homo sapiens
  Payload ID: 3306
  Gene Symbol: C3orf38
  Gene Name: chromosome 3 open reading frame 38
  Uniprot ID: Q5JPI3
  ENSP ID: ENSP00000322469
MEMSGLSFSEMEGCRNLLGLLDNDEIMALCDTVTNRLVQPQDRQDAVHAILAYSQSAEELLRRRKVHREVIFKYLATQGIVIPPATEKHNLIQHAKDYWQKQPQLKLKETPEPVTKTEDIHLFQQQVKEDKKAEKVDFRRLGEEFCHWFFGLLNSQNPFLGPPQDEWGPQHFWHDVKLRFYYNTSEQNVMDYHGAEIVSLRLLSLVKEEFLFLSPNLDSHGLKCASSPHGLVMVGVAGTVHRGNTCLGIFEQIFGLIRCPFVENTWKIKFINLKIMGESSLAPGTLPKPSVKFEQSDLEAFYNVITVCGTNEVRHNVKQASDSGTGDQV

SEQ ID NO: 16529 - protein, 140 aa, Homo sapiens
  Payload ID: 3306
  Gene Symbol: C3orf38
  Gene Name: chromosome 3 open reading frame 38
  ENSP ID: ENSP00000418774
MEMSGLSFSEMEGCRNLLGLLDNDEIMALCDTVTNRLVQPQDRQDAVHAILAYSQSAEELLRRRKVHREVIFKYLATQGIVIPPATEKHNLIQHAKDYWQKQPQLKLKETPEPVTKTEDIHLFQQDHLKMNGDHSTSGMM

SEQ ID NO: 16530 - protein, 292 aa, Homo sapiens
  Payload ID: 3307
  Gene Symbol: C3orf49
  Gene Name: chromosome 3 open reading frame 49
  Uniprot ID: Q96BT1
  ENSP ID: ENSP00000295896
MAQPQLYLPEPFKIAYRKVGQCRRFQQLKKKNGSFKRKGIERWHRAVSTNLLKQNVLVPKEESSSDSDMGFHESQQNQKSNLKTKVKTAFGRMLSYKYRSKPACASQEGSTDHKEALLSNTQSLLPRIVKEFSSPKLFTAKMRKLSENATIQLDVVEAETEEITQGNTLLRARRTTKRLSVTSLPSGLQKGPYSPKKRPHFPALKKKKRGMENILRKSDLTVGKLQMQVDDLIETVTDKSMKLLAQRHAELQQCEFLGDEILQSSKQFQRISKRTMRKYKLKNMTTKGPGDS

SEQ ID NO: 16531 - protein, 292 aa, Homo sapiens [sequence omitted]

SEQ ID NO: 16532 - protein, 217 aa, Homo sapiens
  Payload ID: 3308
  Gene Symbol: C3orf52
  Gene Name: chromosome 3 open reading frame 52
  Uniprot ID: Q5BVD1
  ENSP ID: ENSP00000264848
MDLAQPSQPVDELELSVLERQPEENTPLNGADKVFPSLDEEVPPAEANKESPWSSCNKNVVGRCKLWMIITSIFLGVITVIIIGLCLAAVTYVDEDENEILELSSNKTFFIMLKIPEECVAEEELPHLLTERLTDVYSTSPSLGRYFTSVEIVDFSGENATVTYDLQFGVPSDDENFMKYMMSEELVLGILLQDFRDQNIPGCESLGLDPTSLLLYE

SEQ ID NO: 16533 - protein, 250 aa, Homo sapiens
  Payload ID: 3308
  Gene Symbol: C3orf52
  Gene Name: chromosome 3 open reading frame 52
  Uniprot ID: Q5BVD1
  ENSP ID: ENSP00000399392
MDLAQPSQPVDELELSVLERQPEENTPLNGADKVFPSLDEEVPPAEANKESPWSSCNKNVVGRCKLWMIITSIFLGVITVIIIGLCLAAVTYVDEDENEILELSSNKTFFIMLKIPEECVAEEELPHLLTERNEVMEAGLCLKAVLYQVLEMKGIHSVLQKRFCGLIQKHQQHQRGGDSFLSRFYSLALSPVKQLPSTASAGSSLDKGRKPARVGAIGSAGMSHCWRSLVFCLFLFCFVLFFETGSRSVA

SEQ ID NO: 16534 - protein, 241 aa, Homo sapiens
  Payload ID: 3308
  Gene Symbol: C3orf52
  Gene Name: chromosome 3 open reading frame 52
  ENSP ID: ENSP00000420077
  MOD_RES (1)..(1): Any amino acid
XDELELSVLERQPEENTPLNGADKVFPSLDEEVPPAEANKESPWSSCNKNVVGRCKLWMIITSIFLGVITVIIIGLCLAAVTYVDEDENEILELSSNKTFFIMLKIPEECVAEEELPHLLTERNEVMEAGLCLKAVLYQVLEMKGIHSVLQKRFCGLIQKHQQHQRGGDSFLSRFYSLALSPVKQLPSTASAGSSLDKGRKPARVGAIGSAGMSHCWRSLVFCLFLFCFVLFFETGSRSVA

SEQ ID NO: 16535 - protein, 147 aa, Homo sapiens
  Payload ID: 3308
  Gene Symbol: C3orf52
  Gene Name: chromosome 3 open reading frame 52
  Uniprot ID: Q5BVD1
  ENSP ID: ENSP00000420539
MDLAQPSQPVDELELSVLERQPEENTPLNGADKVFPSLDEEVPPAEANKESPWSSCNKNVVGRCKLWMIITSIFLGVITVIIIGLCLAAVTYVDEDENEILELSSNKTFFIMLKIPEECVAEEELPHLLTEREVGLKPNPEALVGFE

SEQ ID NO: 16536 - protein, 430 aa, Homo sapiens
  Payload ID: 3309
  Gene Symbol: C3orf58
  Gene Name: chromosome 3 open reading frame 58
  Uniprot ID: Q8NDZ4
  ENSP ID: ENSP00000320081
MWRLVPPKLGRLSRSLKLAALGSLLVLMVLHSPSLLASWQRNELTDRRFLQLNKCPACFGTSWCRRFLNGQVVFEAWGRLRLLDFLNVKNVYFAQYGEPREGGRRRVVLKRLGSQRELAQLDQSICKRATGRPRCDLLQAMPRTEFARLNGDVRLLTPEAVEGWSDLVHCPSQRLLDRLVRRYAETKDSGSFLLRNLKDSERMQLLLTLAFNPEPLVLQSFPSDEGWPFAKYLGACGRMVAVNYVGEELWSYFNAPWEKRVDLAWQLMEIAEQLTNNDFEFALYLLDVSFDNFAVGPRDGKVIIVDAENVLVADKRLIRQNKPENWDVWYESKFDDCDKEACLSFSKEILCARATVDHNYYAVCQNLLSRHATWRGTSGGLLHDPPSEIAKDGRLEALLDECANPKKRYGRFQAAKELREYLAQLSNNVR

SEQ ID NO: 16537 - protein, 192 aa, Homo sapiens
  Payload ID: 3309
  Gene Symbol: C3orf58
  Gene Name: chromosome 3 open reading frame 58
  ENSP ID: ENSP00000390796
MVAVNYVGEELWSYFNAPWEKRVDLAWQLMEIAEQLTNNDFEFALYLLDVSFDNFAVGPRDGKVIIVDAENVLVADKRLIRQNKPENWDVWYESKFDDCDKEACLSFSKEILCARATVDHNYYAVCQNLLSRHATWRGTSGGLLHDPPSEIAKDGRLEALLDECANPKKRYGRFQAAKELREYLAQLSNNVR

SEQ ID NO: 16538 - protein, 221 aa, Homo sapiens
  Payload ID: 3309
  Gene Symbol: C3orf58
  Gene Name: chromosome 3 open reading frame 58
  Uniprot ID: Q8NDZ4
  ENSP ID: ENSP00000417382
MKSENGTVVGSFPSDEGWPFAKYLGACGRMVAVNYVGEELWSYFNAPWEKRVDLAWQLMEIAEQLTNNDFEFALYLLDVSFDNFAVGPRDGKVIIVDAENVLVADKRLIRQNKPENWDVWYESKFDDCDKEACLSFSKEILCARATVDHNYYAVCQNLLSRHATWRGTSGGLLHDPPSEIAKDGRLEALLDECANPKKRYGRFQAAKELREYLAQLSNNVR

SEQ ID NO: 16539 - protein, 213 aa, Homo sapiens
  Payload ID: 3309
  Gene Symbol: C3orf58
  Gene Name: chromosome 3 open reading frame 58
  ENSP ID: ENSP00000419947
MESLLLLPRFGRISDLTVDLSTPEGSFPSDEGWPFAKYLGACGRMVAVNYVGEELWSYFNAPWEKRVDLAWQLMEIAEQLTNNDFEFALYLLDVSFDNFAVGPRDGKVIIVDAENVLVADKRLIRQNKPENWDVWYESKFDDCDKEACLSFSKEILCARATVDHNYYAVCQNLLSRHATWRGTSGGLLHDPPSEIAKDGRLEALLDECANPKK

SEQ ID NO: 16540 - protein, 267 aa, Homo sapiens
  Payload ID: 3310
  Gene Symbol: C3orf62
  Gene Name: chromosome 3 open reading frame 62
  Uniprot ID: Q6ZUJ4
  ENSP ID: ENSP00000341139
MHYIKTWSLLGEMSEKLRRCRKELTAAIDRAFEGVSYSQECTGQQRLELSAAPLSFSLPVHRLLCRRHPLAACSSAAPFAAVPCAPENENPAFATNHAPVNAKPHALCPERKPLTSKENVLMHSSILAPERESWRTAGEGENWRKENLRKDMERDLKADSNMPLNNSSQEVTKDLLDMIDHTSIRTIEELAGKIEFENELNHMCGHCQDSPFKEEAWALLMDKSPQKATDADPGSLKQAFDDHNIVETVLDLEEDYNVMTSFKYQIE

SEQ ID NO: 16541 - protein, 98 aa, Homo sapiens
  Payload ID: 3310
  Gene Symbol: C3orf62
  Gene Name: chromosome 3 open reading frame 62
  ENSP ID: ENSP00000391945
GEMSEKLRRCRKELTAAIDRAFEGVSYSQECTGQQRLELSAAPLSFSLPVHRLLCRRHPLAACSSAAPFAAVPCAPENENPAFATNHAPERYGERFEG

SEQ ID NO: 16542 - protein, 190 aa, Homo sapiens
  Payload ID: 3310
  Gene Symbol: C3orf62
  Gene Name: chromosome 3 open reading frame 62
  ENSP ID: ENSP00000413663
MGRRHCAAGEMSEKLRRCRKELTAAIDRAFEGVSYSQECTGQQRLELSAAPLSFSLPVHRLLCRRHPLAACSSAAPFAAVPCAPENENPAFATNHAPVNAKPHALCPERKPLTSKENVLMHSSILAPERESWRTAGEGENWRKENLRKDMERDLKADSNMPLNNSSQEVTKDLLDMIDHTSIRTIEELAG

SEQ ID NO: 16543 - protein, 563 aa, Homo sapiens
  Payload ID: 3311
  Gene Symbol: C3orf67
  Gene Name: chromosome 3 open reading frame 67
  Uniprot ID: Q6ZVT6
  ENSP ID: ENSP00000295966
MIKRKIWCNLCIDLVAFTSEIFKGAVFQSLDGIVVSANCKLRKIFTLKSKPQDTADKDAVYGVPFSTDEPTDIIPRSCQLMTDVPHVTQLLNMTKLRQTEIKFGGHPLRSAESDQFINRGTSITRNSKNQDVCHIAFGSKVLGPPPLSGRRNNMKISSETVRSVGSKNNRSCQPSTVEKCVNGTEMSALLIPESEEQGNKENIHQIKQTVPIHAANLHIMHPHPPQEPSADKNNNRRRLRLKSTSRERTETPSGSSSGNNRIEDKASTILTTVSQQGAELLNSGTLGPQSPDQSDEWIFPENADHISYLASSRQSLLLGDDSCNPSHLWLEASKESEHDQQAEESQSVPKDIFTFSSRPRSAPHGKTQTMSPEELSFILDLKEDNSVTSRDTQSEDDFYGGDSSEEEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQGEEDLSVEEDEEVLTLLYDPCLNCYFDPQTGKYYELV

SEQ ID NO: 16544 - protein, 689 aa, Homo sapiens
  Payload ID: 3311
  Gene Symbol: C3orf67
  Gene Name: chromosome 3 open reading frame 67
  Uniprot ID: Q6ZVT6
  ENSP ID: ENSP00000417122
MIKRKIWCNLCIDLVAFTSEIFKGAVFQSLDGIVVSANCKLRKIFTLKSKPQDTADKDAVYGVPFSTDEPTDIIPRSCQLMTDVPHVTQLLNMTKLRQTEIKFGGHPLRSAESDQFINRGTSITRNSKNQDVCHIAFGSKVLGPPPLSGRRNNMKISSETVRSVGSKNNRSCQPSTVEKCVNGTEMSALLIPESEEQGNKENIHQIKQTVPIHAANLHIMHPHPPQEPSADKNNNRRRLRLKSTSRERTETPSGSSSGNNRIEDKASTILTTVSQQGAELLNSGTLGPQSPDQSDEWIFPENADHISYLASSRQSLLLGDDSCNPSHLWLEASKESEHDQQAEESQSVPKDIFTFSSRPRSAPHGKTQTMSPEELSFILDLKEDNSVTSRDTQSEDDFYGGDSSEEGNHSIQGSRGPTTGPSELTQLTLESLLGKAAKRTSKEYLRSAYTEAGATESQDSSMEQIDRNNFEMSLLPTTCLSPTGRRCGSCQKTPEPVIKAKDLSAQQVPASLNKTSLKEISGERLSSIPEASEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQGEEDLSVEEDEEVLTLLYDPCLNCYFDPQTGKYYELV

SEQ ID NO: 16545 - protein, 334 aa, Homo sapiens
  Payload ID: 3311
  Gene Symbol: C3orf67
  Gene Name: chromosome 3 open reading frame 67
  ENSP ID: ENSP00000417271
MTDVPHVTQLLNMTKLRQTEIKFGGHPLRSAESDQFINRGTSITRNSKNQDVCHIAFGSKVLGPPPLSGRRNNMKISSETVRSVGSKNNRSCQPSTVEKCVNGTEMSALLIPESEEQGNKENIHQIKQTVPIHEPSADKNNNRRRLRLKSTSRERTETPSGSSSGNNRIEDKASTILTTVSQQGAELLNSGTLGPQSPDQSDEWIFPENADHISYLASSRQSLLLGDDSCNPSHLWLEASKESEHDQQAEESQSVPKDIFTFSSRPRSAPHGKTQTMSPEELSFILDLKEDNSVTSRDTQSEDDFYGGDSSEEVHCLISEVVLKHSCFLSSNKH

SEQ ID NO: 16546 - protein, 166 aa, Homo sapiens
  Payload ID: 3311
  Gene Symbol: C3orf67
  Gene Name: chromosome 3 open reading frame 67
  ENSP ID: ENSP00000417639
MFKNEYQGGAFVEIFSAQGKNPGAKWKILGSPSVIWKEFDKEVKSFVFVLEGSSQTNKIQLPKENKQSLGLIQRFLVLQIYVPLGQDFSTELLITDLGNIKRRLYLSTVHKELSSTPLHAKIPLFMIKRKIWCNLCIDLVAFTSEIFKGAVFQSLDGIVVSANCKL

SEQ ID NO: 16547 - protein, 40 aa, Homo sapiens
  Payload ID: 3311
  Gene Symbol: C3orf67
  Gene Name: chromosome 3 open reading frame 67
  ENSP ID: ENSP00000417881
SISTSSDDTTTWNSCLPPPVNQGRHYQKEMNPPSPSNPRL

SEQ ID NO: 16548 - protein, 44 aa, Homo sapiens
  Payload ID: 3311
  Gene Symbol: C3orf67
  Gene Name: chromosome 3 open reading frame 67
  ENSP ID: ENSP00000417917
  MOD_RES (1)..(1): Any amino acid
XDWLNMLSPPIVPPSQQPAEQRPDSCESLSVQDISHTPDQAVTR

SEQ ID NO: 16549 - protein, 74 aa, Homo sapiens
  Payload ID: 3311
  Gene Symbol: C3orf67
  Gene Name: chromosome 3 open reading frame 67
  ENSP ID: ENSP00000418832
MIKRKIWCNLCIDLVAFTSEIFKGAVFQSLDGIVVSANCKLRKIFTLKSKPQDTADKDGMFRLLSRFFNSLMYF

SEQ ID NO: 16550 - protein, 191 aa, Homo sapiens
  Payload ID: 3311
  Gene Symbol: C3orf67
  Gene Name: chromosome 3 open reading frame 67
  ENSP ID: ENSP00000419028
MFKNEYQGGAFVEIFSAQGKNPGAKWKILGSPSVIWKEFDKEVKSFVFVLEGSSQTNKIQLPKENKQSLGLIQRFLVLQIYVPLGQDFSTELLITDLGNIKRRLYLSTVHKELSSTPLHAKIPLFMIKRKIWCNLCIDLVAFTSEIFKGAVFQSLDGIVVSANCKLRKIFTLKSKPQDTADKDGNSAPWNS

SEQ ID NO: 16551 - protein, 196 aa, Homo sapiens
  Payload ID: 3311
  Gene Symbol: C3orf67
  Gene Name: chromosome 3 open reading frame 67
  ENSP ID: ENSP00000419142
MFKNEYQGGAFVEIFSAQGKNPGAKWKILGSPSVIWKEFDKEVKSFVFVLEGSSQTNKIQLPKENKQSLGLIQRFLVLQIYVPLGQDFSTELLITDLGNIKRRLYLSTVHKELSSTPLHAKIPLFMIKRKIWCNLCIDLVAFTSEIFKGAVFQSLDGIVVSANCKLRKIFTLKSKPQDTADKDGMFSCLWCSLFNR

SEQ ID NO: 16552 - protein, 26 aa, Homo sapiens
  Payload ID: 3311
  Gene Symbol: C3orf67
  Gene Name: chromosome 3 open reading frame 67
  ENSP ID: ENSP00000419245
  MOD_RES (1)..(1): Any amino acid
XPPIVPPSQQPAEQRPDSCESLSVQG

SEQ ID NO: 16553 - protein, 186 aa, Homo sapiens
  Payload ID: 3311
  Gene Symbol: C3orf67
  Gene Name: chromosome 3 open reading frame 67
  ENSP ID: ENSP00000419949
NNFEMSLLPTTCLSPTGRRCGSCQKTPEPVIKAKDLSAQQVPASLNKTSLKEISGERLSSIPEASEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQG

SEQ ID NO: 16554 - protein, 79 aa, Homo sapiens
  Payload ID: 3311
  Gene Symbol: C3orf67
  Gene Name: chromosome 3 open reading frame 67
  ENSP ID: ENSP00000421046
  MOD_RES (1)..(1): Any amino acid
XSDDTTTWNSCLPPPVNQGRHYQKEMNPPSPSNPRDWLNMLSPPIVPPSQQPAEQRPDSCESLSVQEEMSGSATAILQL

SEQ ID NO: 16555 - protein, 238 aa, Homo sapiens
  Payload ID: 3311
  Gene Symbol: C3orf67
  Gene Name: chromosome 3 open reading frame 67
  ENSP ID: ENSP00000484997
MSGFPENADHISYLASSRQSLLLGDDSCNPSHLWLEASKESEHDQQAEESQSVPKDIFTFSSRPRSAPHGKTQTMSPEELSFILDLKEDNSVTSRDTQSEDDFYGGDSSEEGNHSIQGSRGPTTGPSELTQLTLESLLGKAAKRTSKEYLRSAYTEAGATESQDSSMEQIDRNNFEMSLLPTTCLSPTGRRCGSCQKTPEPVIKAKDLSAQQVPASLNKTSLKEISGERLSSIPEASE

SEQ ID NO: 16556 - protein, 250 aa, Homo sapiens
  Payload ID: 3312
  Gene Symbol: C3orf70
  Gene Name: chromosome 3 open reading frame 70
  Uniprot ID: A6NLC5
  ENSP ID: ENSP00000334974
MSAAASPASERGWKSEKLDEAQALARSCAARRPDFQPCDGLSICATHSHGKCFKLHWCCHLGWCHCKYMYQPMTPVEQLPSTEIPARPREPTNTIQISVSLTEHFLKFASVFQPPLPPDSPRYCMISDLFIDNYQVKCINGKMCYVQKQPAPHSHRMSPEEVSAHDALISKESNTPKIDHCSSPSSSEDSGINAIGAHYVESCDEDTEEGAELSSEEDYSPESSWEPDECTLLSPSQSDLEVIETIETTV

SEQ ID NO: 16557 - protein, 247 aa, Homo sapiens
  Payload ID: 3313
  Gene Symbol: C3orf80
  Gene Name: chromosome 3 open reading frame 80
  Uniprot ID: F5H4A9
  ENSP ID: ENSP00000313324
MWGPGVTAEGLSVAPAPPPLLPLLLLLALALVAPSRGGGGCAELACGERERCCDATNATAVRCCKLPLHAFLDNVGWFVRKLSGLLILLVLFAIGYFLQRIICPSPRRYPRGQARPGQRPGPPGGAGPLGGAGPPDDDDDSPALLRDEAAAGSQDSLLDSGGGGRGRGGGGRSDPSCASEHEMRVVSPVFLQLPSYEEVKYLPTYEESMRLQQLSPGEVVLPVSVLGRPRGGVAAEPDGGEGRYPLI

SEQ ID NO: 16558 - protein, 204 aa, Homo sapiens
  Payload ID: 3314
  Gene Symbol: C3orf84
  Gene Name: chromosome 3 open reading frame 84
  Uniprot ID: H3BNL1
  ENSP ID: ENSP00000454903
MQSALVGSWHNNGFYGHYRSQFKSESAREYHLAAKPQPPAVFLQRCQEPAQRHFFSKHDNRTSFDKGPYCLLQGIGRRKDLERLWQRHTFLRWAPCEIELRQQGPLESSYQADFRPGPGLSGLPQHLIHFVQVQPSHTRTTYQQNFCCPSQGGHYGSYKVGPQAPVTDVLPDLPGIPRPKLLQHYLHAGVSECLNWSRALNKDS

SEQ ID NO: 16559 - protein, 205 aa, Homo sapiens
  Payload ID: 3314
  Gene Symbol: C3orf84
  Gene Name: chromosome 3 open reading frame 84
  ENSP ID: ENSP00000455944
MQSALVGSWHNNGFYGHYRSQFKSESAREYHLAAKPQPPAVFLQRCQEPAQRHFFSKHDNRTSFDKEGPYCLLQGIGRRKDLERLWQRHTFLRWAPCEIELRQQGPLESSYQADFRPGPGLSGLPQHLIHFVQVQPSHTRTTYQQNFCCPSQGGHYGSYKVGPQAPVTDVLPDLPGIPRPKLLQHYLHAGVSECLNWSRALNKDS

SEQ ID NO: 16560 - protein, 359 aa, Homo sapiens
  Payload ID: 3315
  Gene Symbol: C4orf17
  Gene Name: chromosome 4 open reading frame 17
  Uniprot ID: Q53FE4
  ENSP ID: ENSP00000322582
MNLNPPTSALQIEGKGSHIMARNVSCFLVRHTPHPRRVCHIKGLNNIPICTVNDDENAFGTLWGVGQSNYLEKNRIPFANCSYPSSTAVQESPVRGMSPAPNGAKVPPRPHSEPSRKIKECFKTSSENPLVIKKEEIKAKRPPSPPKACSTPGSCSSGMTSTKNDVKANTICIPNYLDQEIKILAKLCSILHTDSLAEVLQWLLHATSKEKEWVSALIHSELAEINLLTHHRRNTSMEPAAETGKPPTVKSPPTVKLPPNFTAKSKVLTRDTEGDQPTRVSSQGSEENKEVPKEAEHKPPLLIRRNNMKIPVAEYFSKPNSPPRPNTQESGSAKPVSARSIQEYNLCPQRACYPSTHRR

SEQ ID NO: 16561 - protein, 186 aa, Homo sapiens
  Payload ID: 3315
  Gene Symbol: C4orf17
  Gene Name: chromosome 4 open reading frame 17
  Uniprot ID: Q53FE4
  ENSP ID: ENSP00000423411
MNLNPPTSALQIEGKGSHIMARNVSCFLVRHTPHPRRVCHIKGLNNIPICTVNDDENAFGTLWGVGQSNYLEKNRIPFANCSYPSSTAVQESPVRGMSPAPNGAKVPPRPHSEPSRKIKECFKTSSENPLVIKKEEIKAKRPPSPPKACSTPGSCSSGMTSTKNDVKANTICIPNYLDQEIKATLL

SEQ ID NO: 16562 - protein, 294 aa, Homo sapiens
  Payload ID: 3315
  Gene Symbol: C4orf17
  Gene Name: chromosome 4 open reading frame 17
  ENSP ID: ENSP00000427663
MNLNPPTSALQIEGKGSHIMARNVSCFLVRHTPHPRRVCHIKGLNNIPICTVNDDENAFGTLWGVGQSNYLEKNRIPFANCSYPSSTAVQESPVRGMSPAPNGAKVPPRPHSEPSRKIKECFKTSSENPLVIKKEEIKAKRPPSPPKACSTPGSCSSGMTSTKNDVKANTICIPNYLDQEIKILAKLCSILHTDSLAEVLQWLLHATSKEKEWVSALIHSELAEINLLTHHRRNTSMEPAAETGKPPTVKSPPTVKLPPNFTAKSKVLTRDTEGDQPTRVSSQGSEENKEVPKG

SEQ ID NO: 16563 - protein, 314 aa, Homo sapiens
  Payload ID: 3316
  Gene Symbol: C4orf19
  Gene Name: chromosome 4 open reading frame 19
  Uniprot ID: Q8IY42
  ENSP ID: ENSP00000284437
MGCRCCKIIQSYLFDPVQVPSPGYVNEVNSCKLDEDDTDKLKGKWSSEVLVQKNDPQRQGSKKTESSSRTADPWEPCWPHQGPLPQGDAGGEHHACGVNGIGPAATPQPTGNSSPTQDDRGSWASTANTVPPTQPFLEGGGTRKQDCVLLASEGTQVMRNGDSRAPSEAESFALEVQDHVFQIPAPDYLQHWGPAGDNVDHNEKDCVFKNHTEDESLEGIQPPVGEHGLNTPFSVRRSWDSLNEDVETEVLSICFNEKGPVHAMPVVDSGNRQEDTHGSDGDGDGEIVDEDAAVAEALAALEAATAGEDLDETD

SEQ ID NO: 16564 - protein, 314 aa, Homo sapiens; identical to SEQ ID NO: 16563
  Payload ID: 3316
  Gene Symbol: C4orf19
  Gene Name: chromosome 4 open reading frame 19
  Uniprot ID: Q8IY42
  ENSP ID: ENSP00000371408

SEQ ID NO: 16565 - protein, 38 aa, Homo sapiens
  Payload ID: 3316
  Gene Symbol: C4orf19
  Gene Name: chromosome 4 open reading frame 19
  ENSP ID: ENSP00000421537
MGCRCCKIIQRQSLAVVTPAEVQWHDLGSRQPLPPGFN

SEQ ID NO: 16566 - protein, 233 aa, Homo sapiens
  Payload ID: 3317
  Gene Symbol: C4orf22
  Gene Name: chromosome 4 open reading frame 22
  Uniprot ID: Q6V702
  ENSP ID: ENSP00000350818
MDQEEGLKALDNIVTQFNAYEDFLDSQITTVDLYYLEDETLARQLVELGYRGTGERVKREDFEARKAAIEIARLAERAQQKTLTSAGKDLQDNFLTALAMREEDNRSGKLSSVIFIRDRNSHGQEISGYIDYAHRLKTEDFEVYFTGKKRLLPRPTDISFYNWDADIAVSNSSPNYQVIADNPEGLLFRYKRDRKILNVDPKAQPGDNSTRITILTELYVQAVIFDHISRRKT

SEQ ID NO: 16567 - protein, 156 aa, Homo sapiens
  Payload ID: 3317
  Gene Symbol: C4orf22
  Gene Name: chromosome 4 open reading frame 22
  ENSP ID: ENSP00000422569
MDQEEGLKALDNIVTQFNAYEDFLDSQITTVDLYYLEDETLARQLVELGYRGTGERVKREDFEARKAAIEIARLAERAQQKTLTSAGKDLQDNFLTALAMREEDNRSGKLSAGVQWHHLGSLQPLPPGFKEFSCFSLPSSWDYRHAPPHPVRDLYS

SEQ ID NO: 16568 - protein, 250 aa, Homo sapiens
  Payload ID: 3317
  Gene Symbol: C4orf22
  Gene Name: chromosome 4 open reading frame 22
  Uniprot ID: Q6V702
  ENSP ID: ENSP00000425786
MDQEEGLKALDNIVTQFNAYEDFLDSQITTVDLYYLEDETLARQLVELGYRGTGERVKREDFEARKAAIEIARLAERAQQKTLTSAGKDLQDNFLTALAMREEDNRSGKLSLNQQETDAAHILKKQLASVIFIRDRNSHGQEISGYIDYAHRLKTEDFEVYFTGKKRLLPRPTDISFYNWDADIAVSNSSPNYQVIADNPEGLLFRYKRDRKILNVDPKAQPGDNSTRITILTELYVQAVIFDHISRRKT

SEQ ID NO: 16569 - protein, 86 aa, Homo sapiens
  Payload ID: 3317
  Gene Symbol: C4orf22
  Gene Name: chromosome 4 open reading frame 22
  ENSP ID: ENSP00000426308
MDQEEGLKALDNIVTQFNAYEDFLDSQITTVDLYYLEDETLARQLVELGYRGTGERVKREDFEARKAAIEIARLAERAQQKCQTLS

SEQ ID NO: 16570 - protein, 75 aa, Homo sapiens
  Payload ID: 3317
  Gene Symbol: C4orf22
  Gene Name: chromosome 4 open reading frame 22
  ENSP ID: ENSP00000480723
SFYNWDADIAVSNSSPNYQVIADNPEGLLFRYKRDRKILNVDPKAQPGDNSTRITILTELYVQAVIFDHISRRKT

SEQ ID NO: 16571 - protein, 130 aa, Homo sapiens
  Payload ID: 3318
  Gene Symbol: C4orf26
  Gene Name: chromosome 4 open reading frame 26
  Uniprot ID: Q17RF5
  ENSP ID: ENSP00000311307
MARRHCFSYWLLVCWLVVTVAEGQEEVFTPPGDSQNNADATDCQIFTLTPPPAPRSPVTRAQPITKTPRCPFHFFPRRPRIHFRFPNRPFVPSRCNHRFPFQPFYWPHRYLTYRYFPRRRLQRGSSSEES

SEQ ID NO: 16572 - protein, 176 aa, Homo sapiens
  Payload ID: 3318
  Gene Symbol: C4orf26
  Gene Name: chromosome 4 open reading frame 26
  Uniprot ID: Q17RF5
  ENSP ID: ENSP00000406925
MARRHCFSYWLLVCWLVVTVAEALSTFYLQQHINLHMDKKRYLRLLEIHKIMRTLPTARSLHSPLHLPRGVRSQGPSPSQRHPGVPSIFFHEGPESILGFQTDLSSLQGVTTVFHSSHFIGHTVTLLIGISPEEDSREEAHLRKAEREEKPKHTEAKKSLSFRKKQQKDFCFIFRN

SEQ ID NO: 16573 - protein, 40 aa, Homo sapiens
  Payload ID: 3318
  Gene Symbol: C4orf26
  Gene Name: chromosome 4 open reading frame 26
  ENSP ID: ENSP00000421429
MARRHCFSYWLLVCWLVVTVAEVETGFHHVSQDGLDLLTS

SEQ ID NO: 16574 - protein, 85 aa, Homo sapiens
  Payload ID: 3318
  Gene Symbol: C4orf26
  Gene Name: chromosome 4 open reading frame 26
  ENSP ID: ENSP00000479147
MARRHCFSYWLLVCWLVVTVAEGQEEVFTPPGDSQNNADATDCQIFTLTPPPAPRSPVTRAQPITKTPRYFPRRRLQRGSSSEES

SEQ ID NO: 16575 - protein, 346 aa, Homo sapiens [sequence omitted]

SEQ ID NO: 16576 - protein, 199 aa, Homo sapiens
  Payload ID: 3320
  Gene Symbol: C4orf3
  Gene Name: chromosome 4 open reading frame 3
  Uniprot ID: Q8WVX3
  ENSP ID: ENSP00000382026
MTSLINSPINRRPLQNVEGNNRCQRKAKNYGNKYFIHCLDLEKITLSPRRKHDIEGGDKLNVKFSQLRSRRQRKAEPGACALGRVGSECIPEPGARRTAQAAGLRSVSGAANTKVRELKHFRFLGLLRSCRSEMEVDAPGVDGRDGLRERRGFSEGGRQNFDVRPQSGANGLPKHSYWLDLWLFILFDVVVFLFVYFLP

SEQ ID NO: 16577 - protein, 66 aa, Homo sapiens
  Payload ID: 3320
  Gene Symbol: C4orf3
  Gene Name: chromosome 4 open reading frame 3
  Uniprot ID: Q8WVX3
  ENSP ID: ENSP00000485697
MEVDAPGVDGRDGLRERRGFSEGGRQNFDVRPQSGANGLPKHSYWLDLWLFILFDVVVFLFVYFLP

SEQ ID NO: 16578 - protein, 132 aa, Homo sapiens
  Payload ID: 3321
  Gene Symbol: C4orf32
  Gene Name: chromosome 4 open reading frame 32
  Uniprot ID: Q8N8J7
  ENSP ID: ENSP00000310182
MCSAGELLRGGDGGERDEDGDALAEREAAGTGWDPGASPRRRGQRPKESEQDVEDSQNHTGEPVGDDYKKMGTLFGELNKNLINMGFTRMYFGERIVEPVIVIFFWVMLWFLGLQALGLVAVLCLVIIYVQQ

SEQ ID NO: 16579 - protein, 199 aa, Homo sapiens
  Payload ID: 3322
  Gene Symbol: C4orf33
  Gene Name: chromosome 4 open reading frame 33
  Uniprot ID: Q8N1A6
  ENSP ID: ENSP00000281146
MDFKIEHTWDGFPVKHEPVFIRLNPGDRGVMMDISAPFFRDPPAPLGEPGKPFNELWDYEVVEAFFLNDITEQYLEVELCPHGQHLVLLLSGRRNVWKQELPLSFRMSRGETKWEGKAYLPWSYFPPNVTKFNSFAIHGSKDKRSYEALYPVPQHELQQGQKPDFHCLEYFKSFNFNTLLGEEWKQPESDLWLIEKCDI

SEQ ID NO: 16580 - protein, 199 aa, Homo sapiens; identical to SEQ ID NO: 16579
  Payload ID: 3322
  Gene Symbol: C4orf33
  Gene Name: chromosome 4 open reading frame 33
  Uniprot ID: Q8N1A6
  ENSP ID: ENSP00000401090

SEQ ID NO: 16581 - protein, 102 aa, Homo sapiens
  Payload ID: 3322
  Gene Symbol: C4orf33
  Gene Name: chromosome 4 open reading frame 33
  ENSP ID: ENSP00000427096
MDFKIEHTWDGFPVKHEPVFIRLNPGDRGVMMDISAPFFRDPPAPLGEPGKPFNELWDYEVVEAFFLNDITEQYLEVELCPKNFLYRSECPEERQNGKAKLI

SEQ ID NO: 16582 - protein, 165 aa, Homo sapiens
  Payload ID: 3322
  Gene Symbol: C4orf33
  Gene Name: chromosome 4 open reading frame 33
  ENSP ID: ENSP00000427406
MDFKIEHTWDGFPVKHEPVFIRLNPGDRGVMMDISAPFFRDPPAPLGEPGKPFNELWDYEVVEAFFLNDITEQYLEVELCPHGQHLVLLLSGRRNVWKQELPLSFRMSRGETKWEGKAYLPWSYFPPNVTKFNSFAIHGSKDKRSYEALYPVPQHELQQGQKPDL

SEQ ID NO: 16583 - protein, 64 aa, Homo sapiens
  Payload ID: 3322
  Gene Symbol: C4orf33
  Gene Name: chromosome 4 open reading frame 33
  ENSP ID: ENSP00000427431
MDFKIEHTWDGFPVKHEPVFIRLNPGDRGVMMDISAPFFRDPPAPLGEPGKPFNELWDYEVVEA

SEQ ID NO: 16584 - protein, 117 aa, Homo sapiens
  Payload ID: 3323
  Gene Symbol: C4orf36
  Gene Name: chromosome 4 open reading frame 36
  Uniprot ID: Q96KX1
  ENSP ID: ENSP00000295898
MAYGVPRKNTVKTILRGSCYNVQEPWDIALLAKTWSTNLANIKLPFLEEISFGGSVQLTKCTTIKDGLLPSAESIKLEREYEVKRLCKLKCQENTSKEIQLLLRERPAGLRRPLPSK

SEQ ID NO: 16585 - protein, 117 aa, Homo sapiens; identical to SEQ ID NO: 16584
  Payload ID: 3323
  Gene Symbol: C4orf36
  Gene Name: chromosome 4 open reading frame 36
  Uniprot ID: Q96KX1
  ENSP ID: ENSP00000420949

SEQ ID NO: 16586 - protein, 113 aa, Homo sapiens
  Payload ID: 3323
  Gene Symbol: C4orf36
  Gene Name: chromosome 4 open reading frame 36
  ENSP ID: ENSP00000421141
MAYGVPRKNTVKTILRGSCYNVQEPWDIALLAKTWSTNLANIKLPFLEEISFGGSVQLTKCTTIKDGLLPSAESIKLEREYEVKRLCKLKCQENTSKEIQLLLRERPAGLRRP

SEQ ID NO: 16587 - protein, 32 aa, Homo sapiens
  Payload ID: 3323
  Gene Symbol: C4orf36
  Gene Name: chromosome 4 open reading frame 36
  ENSP ID: ENSP00000421568
MAYGVPRKNTVKTILRGSCYNVLECCAPPGLE

SEQ ID NO: 16588 - protein, 81 aa, Homo sapiens
  Payload ID: 3323
  Gene Symbol: C4orf36
  Gene Name: chromosome 4 open reading frame 36
  ENSP ID: ENSP00000422720
MAYGVPRKNTVKTILRGSCYNVQEPWDIALLAKTWSTNLANIKLPFLEEISFGGSVQLTKCTTIKDGLLPSAESIKLEREY

SEQ ID NO: 16589 - protein, 46 aa, Homo sapiens
  Payload ID: 3323
  Gene Symbol: C4orf36
  Gene Name: chromosome 4 open reading frame 36
  ENSP ID: ENSP00000427122
MAYGVPRKNTVKTILRGSCYNVVSHCHAGWNVVHLLGLSDPPISAS

SEQ ID NO: 16590 - protein, 186 aa, Homo sapiens
  Payload ID: 3324
  Gene Symbol: C4orf45
  Gene Name: chromosome 4 open reading frame 45
  Uniprot ID: Q96LM5
  ENSP ID: ENSP00000412215
MASVSYQKPTSTTVGKQMIFTGPDYIKDYLPKIHQHTSYVGEQHLALEKTGDLRYLWRPASNRSLPAKYKHEYVSEIGWRIPQYNFINKSRLGSGFHIKYEELSQASLDSITHRYQNPWQPKPHVLDMQGKQSRASFAWHMSAFEDTDQRNSKWAILVRQCKSSLPRASKPPKLPKLPKKEKKRKH

SEQ ID NO: 16591 - protein, 113 aa, Homo sapiens
  Payload ID: 3325
  Gene Symbol: C4orf46
  Gene Name: chromosome 4 open reading frame 46
  Uniprot ID: Q504U0
  ENSP ID: ENSP00000368503
MADPEELQVSSPPPPPPSSPSSSDASAASSPGGPVSLGWPVPSRSSGPTVDQLEEVELQIGDAAFSLTKLLEATSAVSAQVEELAFKCTENARFLKTWRDLLKEGYDSLKPDD

SEQ ID NO: 16592 - protein, 65 aa, Homo sapiens
  Payload ID: 3325
  Gene Symbol: C4orf46
  Gene Name: chromosome 4 open reading frame 46
  ENSP ID: ENSP00000421533
MADPEELQVSSPPPPPPSSPSSSDASAASSPGGPVSLGWPVPSRSSGPTVDQLEEVELQIGDPFH

SEQ ID NO: 16593 - protein, 309 aa, Homo sapiens
  Payload ID: 3326
  Gene Symbol: C4orf47
  Gene Name: chromosome 4 open reading frame 47
  Uniprot ID: A7E2U8
  ENSP ID: ENSP00000368127
MPAEGGKTDMERIGLFSEMEYITVGDKYVSQFNRPFNEAASKNKQMLPGGSKEMSDLQAGYFDPHFVRIFEGEGYINLNQVRRRDMVEAAKKNLGKAFLPSNGEKKPCGLGSYYGTIGGPVPFFSAQSKPREKYKAPGKNLYTNPGKKGTGYGYANITIGKQFSHSADFYDAAKLKYKKANEEHHRLLKGAPFKLNLHPRDYFDANPYFSEESLPPIKKEEKKKTISNTFKPSSPGKKPGGMKAGTFDPYPSHSADPYVAKLANISGKDDKIFHPPSGPKSRPVESIMTLNVRRALNSKNYKTSSVPSY

SEQ ID NO: 16594 - protein, 161 aa, Homo sapiens
  Payload ID: 3326
  Gene Symbol: C4orf47
  Gene Name: chromosome 4 open reading frame 47
  ENSP ID: ENSP00000422279
MPAEGGKTDMERIGLFSEMEYITVGDKYVSQFNRPFNEAASKNKQMLPGGSKEMSDLQAGYFDPHFVRIFEGEGYINLNQVRRRDMVEAAKKNLGKAFLPSNGEKKPCGLGSYYGTIGGPVPFFSAQSKPREKYKAPGKNLYTNPGKKGTGYGYANITIGK

SEQ ID NO: 16595 - protein, 178 aa, Homo sapiens
  Payload ID: 3326
  Gene Symbol: C4orf47
  Gene Name: chromosome 4 open reading frame 47
  ENSP ID: ENSP00000423127
MPAEGGKTDMERIGLFSEMEYITVGDKYVSQFNRPFNEAASKNKQMLPGGSKEMSDLQAGYFDPHFVRIFEGEGYINLNQVRRRDMVEAAKKNLGKAFLPSNGEKKPCGLGSYYGTIGGPVPFFSAQSKPREKYKAPGKNLYTNPGKKGTGYGYANITIGKQFSHSADFYDAAKLKYK

SEQ ID NO: 16596 - protein, 36 aa, Homo sapiens
  Payload ID: 3326
  Gene Symbol: C4orf47
  Gene Name: chromosome 4 open reading frame 47
  ENSP ID: ENSP00000425418
MPAEGGKTDMERIGLFSEMEYITVGDKYVSQFNHVA

SEQ ID NO: 16597 - protein, 95 aa, Homo sapiens
  Payload ID: 3327
  Gene Symbol: C4orf48
  Gene Name: chromosome 4 open reading frame 48
  Uniprot ID: Q5BLP8
  ENSP ID: ENSP00000386528
MAPPPACRSPMSPPPPPLLLLLLSLALLGARARAEPAGSAVPAQSRPCVDCHAFEFMQRALQDLRKTACSLDARTETLLLQAERRALCACWPAGH

SEQ ID NO: 16598 - protein, 128 aa, Homo sapiens
  Payload ID: 3327
  Gene Symbol: C4orf48
  Gene Name: chromosome 4 open reading frame 48
  Uniprot ID: Q5BLP8
  ENSP ID: ENSP00000386807
MRVARRTRNVCRCPRAAGPGVPEPRAAPLPLLAMAPPPACRSPMSPPPPPLLLLLLSLALLGARARAEPAGSAVPAQSRPCVDCHAFEFMQRALQDLRKTACSLDARTETLLLQAERRALCACWPAGH

SEQ ID NO: 16599 - protein, 276 aa, Homo sapiens
  Payload ID: 3328
  Gene Symbol: C4orf50
  Gene Name: chromosome 4 open reading frame 50
  Uniprot ID: Q6ZRC1
  ENSP ID: ENSP00000317287
MLRDSEAEVTEEDPRLRAQQLHHRVLTLQCQLRDQGAAHQASLDEATRLQEELQAKLEELQKKQHEAKLAVTPLKAKIASLVRKCRERNRLITHLLQELHRHGLGNLLLSELAQNMLNDVALAEYTATFLAPGVPETSHHLDVKSEMTAALRAQTYLLNPEMDSVLQSSLSSESWPIPEPEWPAQTAQLDSLKLPLSLVSTLDPGTCLAAVTVEPGLPAQRLQEKGGMPCPALQVDNVPAPSELLSPARILAFHQELRQSICSNSQVHKSPLELEM

SEQ ID NO: 16600 - protein, 750 aa, Homo sapiens
  Payload ID: 3328
  Gene Symbol: C4orf50
  Gene Name: chromosome 4 open reading frame 50
  ENSP ID: ENSP00000437121
MLFFAGETGLPLFPRFALSVEGAEPTDHGHPQAVSKGHNRCALTIDELAQDVEACFQQLSTLQPGSRGWQCSASACRGENWSFAQKWHSGWERAHSQQVWGNWGICSNEEAKSKESGEGDKPGKTTALGTSEVPGNPGTLPHWDEASPNPPQGPAEPWGALERVRSRFHQLISGLKKQRSQILHDNTKLHGDQERFHERVCALEREREREVTKISRLERDNHRLVGDISQLKKELDQYLQAISDLEDCNGKSYCKILELEEENETLKGNLGQLQKATSESVRKSKDTMEQVTLENWKLQTLISELGVSYKELIKDIVLGIEDMIRALSGENEHLLRRVHVLEREVTLQRSTDQGRLVRGREHLQGKAKMHALDKEVQVTPLTGQLLSRACGPPLEEEMSLAAGQTGPSTGTGNSRRGADSPPPSLVWRNTGVANALQGNVSGAEVKEAHLEKEEKRPRCSVAQGQALSSLSNGPMLRDSEAEVTEEDPRLRAQQLHHRVLTLQCQLRDQGAAHQASLDEATRLQEELQAKLEELQKKQHEAKLAVTPLKAKIASLVRKCRERNRLITHLLQELHRHGLGNLLLSELAQNMLNDVALAEYTATFLAPGVPETSHHLDVKSEMTAALRAQTYLLNPEMDSVLQSSLSSESWPIPEPEWPAQTAQLDSLKLPLSLVSTLDPGTCLAAVTVEPGLPAQRLQEKGGMPCPALQVDNVPAPSELLSPARILAFHQELRQSICSNSQVHKSPLELEM

SEQ ID NO: 16601 - protein, 202 aa, Homo sapiens
  Payload ID: 3329
  Gene Symbol: C4orf51
  Gene Name: chromosome 4 open reading frame 51
  Uniprot ID: C9J302
  ENSP ID: ENSP00000391404
MSHYFYLTPQILLPFSPLTSQEFDLIRRKAGASWQDETRWSDSSVTTYTGSYRKKQLDKSMCSQFSFRAGQHEPECKQMSLTNSSACHLLCWAGTQETTDIKGLFPDITRPFKKSFDVKHGVAHQIWDFGDCFPTPPNYGKYCVRPKKPAQEALINYSRRGKGVLKHLHGRCDSESKVCSSEDSEADRYSDYGWGGPSSPFN

SEQ ID NO: 16602 - protein, 162 aa, Homo sapiens
  Payload ID: 3329
  Gene Symbol: C4orf51
  Gene Name: chromosome 4 open reading frame 51
  ENSP ID: ENSP00000425306
  MOD_RES (1)..(1): Any amino acid
XDSSVTTYTGSYRKKQLDKSMCSQFSFRAGQHEPECKQMSLTNSSACHLLCWAGTQETTDIKGLFPDITRPFKKSFDVKHGVAHQIWDFGDCFPTPPNYGKYCVRPKKPAQEALINYSRRGKGVLKHLHGRCDSESKVCSSEDSEADRYSDYGWGGPSSPFN

SEQ ID NO: 16603 - protein, 265 aa, Homo sapiens
  Payload ID: 3330
  Gene Symbol: C5orf15
  Gene Name: chromosome 5 open reading frame 15
  Uniprot ID: Q8NC54
  ENSP ID: ENSP00000231512
MAAAVPKRMRGPAQAKLLPGSAIQALVGLARPLVLALLLVSAALSSVVSRTDSPSPTVLNSHISTPNVNALTHENQTKPSISQISTTLPPTTSTKKSGGASVVPHPSPTPLSQEEADNNEDPSIEEEDLLMLNSSPSTAKDTLDNGDYGEPDYDWTTGPRDDDESDDTLEENRGYMEIEQSVKSFKMPSSNIEEEDSHFFFHLIIFAFCIAVVYITYHNKRKIFLLVQSRKWRDGLCSKTVEYHRLDQNVNEAMPSLKITNDYIF

SEQ ID NO: 16604 - protein, 442 aa, Homo sapiens
  Payload ID: 3331
  Gene Symbol: C5orf22
  Gene Name: chromosome 5 open reading frame 22
  Uniprot ID: Q49AR2
  ENSP ID: ENSP00000326879
MSDSAGGRAGLRRYPKLPVWVVEDHQEVLPFIYRAIGSKHLPASNVSFLHFDSHPDLLIPVNMPADTVFDKETLFGELSIENWIMPAVYAGHFSHVIWFHPTWAQQIREGRHHFLVGKDTSTTTIRVTSTDHYFLSDGLYVPEDQLENQKPLQLDVIMVKPYKLCNNQEENDAVSSAKKPKLALEDSENTASTNCDSSSEGLEKDTATQRSDQTCLEPSCSCSSENQECQTAASTGEILEILKKGKAFVLDIDLDFFSVKNPFKEMFTQEEYKILQELYQFKKPGTNLTEEDLVDIVDTRIHQLEDLEATFADLCDGDDEETVQRWASNPGMESLVPLVQSLKKRMEVPDYEMVHQAGLTCDYSELPHHISTEQEIECLIQSVHYLLKNLPNPTLVTIARSSLDDYCPSDQVDTIQEKVLNMLRALYGNLDLQVYAAESPPS

SEQ ID NO: 16605 - protein, 136 aa, Homo sapiens
  Payload ID: 3331
  Gene Symbol: C5orf22
  Gene Name: chromosome 5 open reading frame 22
  ENSP ID: ENSP00000421667
MSDSAGGRAGLRRYPKLPVWVVEDHQEVLPFIYRAIGSKHLPASNVSFLHFDSHPDLLIPVNMPADTVFDKETLFGELSIENWIMPAVYAGHFSHVIWFHPTWAQQIREGRHHFLVGKDTSTTTIRTGKGHSNTEK

SEQ ID NO: 16606 - protein, 136 aa, Homo sapiens; identical to SEQ ID NO: 16605
  Payload ID: 3331
  Gene Symbol: C5orf22
  Gene Name: chromosome 5 open reading frame 22
  ENSP ID: ENSP00000423039

SEQ ID NO: 16607 - protein, 49 aa, Homo sapiens
  Payload ID: 3331
  Gene Symbol: C5orf22
  Gene Name: chromosome 5 open reading frame 22
  ENSP ID: ENSP00000428898
MSDSAGGRAGLRRYPKLPVWVVEDHQEVLPFIYRAIGSKHLPASNRIKY

SEQ ID NO: 16608 - protein, 136 aa, Homo sapiens; identical to SEQ ID NO: 16605
  Payload ID: 3331
  Gene Symbol: C5orf22
  Gene Name: chromosome 5 open reading frame 22
  ENSP ID: ENSP00000430261

SEQ ID NO: 16609 - protein, 156 aa, Homo sapiens
  Payload ID: 3331
  Gene Symbol: C5orf22
  Gene Name: chromosome 5 open reading frame 22
  ENSP ID: ENSP00000430860
MSDSAGGRAGLRRYPKLPVWVVEDHQEVLPFIYRAIGSKHLPASNVSFLHFDSHPDLLIPVNMPADTVFDKETLFGDHWILTSISAFSPLPYAVLVEIYDEDSGFHRELSIENWIMPAVYAGHFSHVIWFHPTWAQQIREGRHHFLVGKDTSTTTI

SEQ ID NO: 16610 - protein, 188 aa, Homo sapiens
  Payload ID: 3332
  Gene Symbol: C5orf24
  Gene Name: chromosome 5 open reading frame 24
  Uniprot ID: Q7Z6I8
  ENSP ID: ENSP00000337044
MMHPVASSNPAFCGPGKPSCLNEDAMRAADQFDIYSSQQSKYSHTVNHKPMVCQRQDPLNETHLQTTSGRSIEIKDELKKKKNLNRSGKRGRPSGTTKSAGYRTSTGRPLGTTKAAGFKTSPGRPLGTTKAAGYKVSPGRPPGSIKALSRLADLGYGCGTAAFPYPMMHGRAVHGVEETSSEVKPPNE

SEQ ID NO: 16611 - protein, 188 aa, Homo sapiens; identical to SEQ ID NO: 16610
  Payload ID: 3332
  Gene Symbol: C5orf24
  Gene Name: chromosome 5 open reading frame 24
  Uniprot ID: Q7Z6I8
  ENSP ID: ENSP00000378427

SEQ ID NO: 16612 - protein, 188 aa, Homo sapiens; identical to SEQ ID NO: 16610
  Payload ID: 3332
  Gene Symbol: C5orf24
  Gene Name: chromosome 5 open reading frame 24
  Uniprot ID: Q7Z6I8
  ENSP ID: ENSP00000395764

SEQ ID NO: 16613 - protein, 155 aa, Homo sapiens
  Payload ID: 3332
  Gene Symbol: C5orf24
  Gene Name: chromosome 5 open reading frame 24
  Uniprot ID: Q7Z6I8
  ENSP ID: ENSP00000421647
MMHPVASSNPAFCGPGKPSCLNEDAMRAADQFDIYSSQQSKYSHTVNHKPMVCQRQDPLNETHLQTTSGRSIEIKDELKKKKNLNRSGKRGRPSGTTKSAGYRTSTGRPLGTTKAAGFKTSPGRPLGTTKAAGYKVSPGRPPGKKQQAFRCSSDA

SEQ ID NO: 16614 - protein, 7 aa, Homo sapiens
  Payload ID: 3332
  Gene Symbol: C5orf24
  Gene Name: chromosome 5 open reading frame 24
  ENSP ID: ENSP00000422620
MMHPVAS

SEQ ID NO: 16615 - protein, 84 aa, Homo sapiens
  Payload ID: 3332
  Gene Symbol: C5orf24
  Gene Name: chromosome 5 open reading frame 24
  ENSP ID: ENSP00000426824
  MOD_RES (1)..(1): Any amino acid
XPSCLNEDAMRAADQFDIYSSQQSKYSHTVNHKPMVCQRQDPLNETHLQTTSGRSIEIKDELKKKKNLNRSGKKQQAFRCSSDA

SEQ ID NO: 16616 - protein, 215 aa, Homo sapiens
  Payload ID: 3333
  Gene Symbol: C5orf28
  Gene Name: chromosome 5 open reading frame 28
  Uniprot ID: Q0VDI3
  ENSP ID: ENSP00000380270
MASETEKTHALLQTCSTESLISSLGLGAFCLVADRLLQFSTIQQNDWLRALSDNAVHCVIGMWSWAVVTGIKKKTDFGEIILAGFLASVIDVDHFFLAGSMSLKAALTLPRRPFLHCSTVIPVVVLTLKFTMHLFKLKDSWCFLPWMLFISWTSHHIRDGIRHGLWICPFGKTSPLPFWLYVIITSSLPHICSFVMYLTGTRQMMSSKHGVRIDV

SEQ ID NO: 16617 - protein, 215 aa, Homo sapiens; identical to SEQ ID NO: 16616
  Payload ID: 3333
  Gene Symbol: C5orf28
  Gene Name: chromosome 5 open reading frame 28
  Uniprot ID: Q0VDI3
  ENSP ID: ENSP00000422881

SEQ ID NO: 16618 - protein, 176 aa, Homo sapiens
  Payload ID: 3333
  Gene Symbol: C5orf28
  Gene Name: chromosome 5 open reading frame 28
  ENSP ID: ENSP00000424720
MASETEKTHALLQTCSTESLISSLGLGAFCLVADRLLQFSTIQQNDWLRALSDNAVHCVIGMWSWAVVTGIKKKTDFGEIILAGFLASVIDVDHFFLAGSMSLKAALTLPRRPFLHCSTVIPVVVLTLKFTMHLFKLKDSWCFLPWMLFISWTSHHIRDGIRHGLWICPFGKTSPL

SEQ ID NO: 16619 - protein, 215 aa, Homo sapiens; identical to SEQ ID NO: 16616
  Payload ID: 3333
  Gene Symbol: C5orf28
  Gene Name: chromosome 5 open reading frame 28
  Uniprot ID: Q0VDI3
  ENSP ID: ENSP00000426067

SEQ ID NO: 16620 - protein, 113 aa, Homo sapiens
  Payload ID: 3333
  Gene Symbol: C5orf28
  Gene Name: chromosome 5 open reading frame 28
  ENSP ID: ENSP00000427099
MEAALTLPRRPFLHCSTVIPVVVLTLKFTMHLFKLKDSWCFLPWMLFISWTSHHIRDGIRHGLWICPFGKTSPLPFWLYVIITSSLPHICSFVMYLTGTRQMMSSKHGVRIDV

SEQ ID NO: 16621 - protein, 206 aa, Homo sapiens
  Payload ID: 3334
  Gene Symbol: C5orf30
  Gene Name: chromosome 5 open reading frame 30
  Uniprot ID: Q96GV9
  ENSP ID: ENSP00000326110
MEVDINGESRSTLTTLPFPGAEANSPGKAEAEKPRCSSTPCSPMRRTVSGYQILHMDSNYLVGFTTGEELLKLAQKCTGGEESKAEAMPSLRSKQLDAGLARSSRLYKTRSRYYQPYEIPAVNGRRRRRMPSSGDKCTKSLPYEPYKALHGPLPLCLLKGKRAHSKSLDYLNLDKMIKEPADTEVLQYQLQHLTLRGDRVFARNNT

SEQ ID NO: 16622 - protein, 206 aa, Homo sapiens; identical to SEQ ID NO: 16621
  Payload ID: 3334
  Gene Symbol: C5orf30
  Gene Name: chromosome 5 open reading frame 30
  Uniprot ID: Q96GV9
  ENSP ID: ENSP00000421270

SEQ ID NO: 16623 - protein, 206 aa, Homo sapiens; identical to SEQ ID NO: 16621
  Payload ID: 3334
  Gene Symbol: C5orf30
  Gene Name: chromosome 5 open reading frame 30
  Uniprot ID: Q96GV9
  ENSP ID: ENSP00000422836

SEQ ID NO: 16624 - protein, 638 aa, Homo sapiens
  Payload ID: 3335
  Gene Symbol: C5orf34
  Gene Name: chromosome 5 open reading frame 34
  Uniprot ID: Q96MH7
  ENSP ID: ENSP00000303490
MAAELRMILYEDDSVQVQYVDGSTLQLSPCGSEFLFEKSPPVSAHPLEQPERIRQRTHFVISTYREQLQRALDFRNSSATCPFLSETIIPSERKKHIFIDITEVRWPSLDTDGTMIYMESGIVKITSLDGHAYLCLPRSQHEFTVHFLCKVSQKSDSSAVLSETNNKAPKDKLVEKTGKICIRGNLPGQRLKNKENEFHCQIMKSKETLKKMSCVNGTEGREELPSPGTKHTCVYTWVKQCWSVAACPEEWKYPLSLALHFHNKISNMSKIDAHITQSRFLTSDISEERGKVVSVLPRALSLSCPVPHLHRWNFCDSLLQRQSDEYSYPELVKMVWYKGVTYRLTHQNMNSIEIYSGDGSVFKSEGAYFGNYFTYYSIQEGSGKREEKTYSVNNLPPDRPGSPFTVGSLIKQATRILQHCVKMRLSLSHNYRICCWKMVPGINDSNILPLVLKESLIPSVGRFLAYSDDKVHAIFLDGITLTLNWNFSSPIEKRQVNQGLNLGWCKLTFPDGQEQLIQIEHPEPYERYVTTVTSWCRRLTQTSPREMPTHSSSSVLQENWSVASELEKIQKFNLLLENSGILNQISNKKNEQQSFDHYKPGSSETLLGEVNENRVSIALKKTSEILHDIDCLLSNSKK

SEQ ID NO: 16625 - protein, 228 aa, Homo sapiens
  Payload ID: 3335
  Gene Symbol: C5orf34
  Gene Name: chromosome 5 open reading frame 34
  ENSP ID: ENSP00000424486
MIYMESGIVKITSLDGHAYLCLPRSQHEFTVHFLCKVSQKSDSSAVLSETNNKAPKDKLVEKTGKICIRGNLPGQRLKNKENEFHCQIMKSKETLKKMSCVNGTEGREELPSPGTKHTCVYTWVKQCWSVAACPEEWKYPLSLALHFHNKISNMSKIDAHITQSRFLTSDISEERGKVVSVLPRALSLSCPVPHLHRWNFCDSLLQRQSDEYSYPELVKMVWYKGVTY

SEQ ID NO: 16626 - protein, 126 aa, Homo sapiens
  Payload ID: 3335
  Gene Symbol: C5orf34
  Gene Name: chromosome 5 open reading frame 34
  ENSP ID: ENSP00000426724
  MOD_RES (1)..(1): Any amino acid
XSPGTKHTCVYTWVKQCWSVAACPEEWKYPLSLALHFHNKISNMSKIDAHITQSRFLTSDISEERGKVVSVLPRALSLSCPVPHLHRWNFCDSLLQRQSDEYSYPELVKMVWYKGVTYREKRKLTQ

SEQ ID NO: 16627 - protein, 138 aa, Homo sapiens
  Payload ID: 3336
  Gene Symbol: C5orf38
  Gene Name: chromosome 5 open reading frame 38
  Uniprot ID: Q86SI9
  ENSP ID: ENSP00000334267
MVAPAARVFLRAVRAALTSTVPDLLCLLARGSPRGLASGRLPLAVHSAQHGPGSGAPWLRIARRALRFVLSKHWGDDCYLTNRLWQDLKPPSHVENGQELRLAPPVQWALQVQGNQLQTAVLCLRMAPPEPAGSRQRI

SEQ ID NO: 16628 - protein, 226 aa, Homo sapiens
  Payload ID: 3336
  Gene Symbol: C5orf38
  Gene Name: chromosome 5 open reading frame 38
  Uniprot ID: Q86SI9
  ENSP ID: ENSP00000380935
MVAPAARVFLRAVRAALTSTVPDLLCLLARGSPRGLASGRLPLAVHSAQHGPGSGAPWLRIARRALRFVLSKHWGDDCYLTNRLWQDLKPPSHVENGQELRLAPPVQWALQPKNLERVYVDTQVSASGDFLRGRARGTAGPGGSGSGSPRGRGRLRRPGRSPGAAPSSVSRGRKEATQARSRARGRRGGAVARVCRPESRQRWARPTSSPGGLIRGRRKNGIEAFQ

SEQ ID NO: 16629 - protein, 70 aa, Homo sapiens
  Payload ID: 3336
  Gene Symbol: C5orf38
  Gene Name: chromosome 5 open reading frame 38
  Uniprot ID: Q86SI9
  ENSP ID: ENSP00000408820
MVAPAARVFLRAVRAALTSTVPDLLCLLARGSPRGLASGRLPLAVHSAQHGPGSGAPWLRIARRALSQRI

SEQ ID NO: 16630 - protein, 68 aa, Homo sapiens
  Payload ID: 3336
  Gene Symbol: C5orf38
  Gene Name: chromosome 5 open reading frame 38
  ENSP ID: ENSP00000424088
MVAPAARVFLRAVRAALTSTVPDLLCLLARGSPRGLASGRLPLAVHSAQHGPGSGAPWLRIARRALRT

SEQ ID NO: 16631 - protein, 68 aa, Homo sapiens; identical to SEQ ID NO: 16630
  Payload ID: 3336
  Gene Symbol: C5orf38
  Gene Name: chromosome 5 open reading frame 38
  ENSP ID: ENSP00000425109

SEQ ID NO: 16632 - protein, 135 aa, Homo sapiens
  Payload ID: 3336
  Gene Symbol: C5orf38
  Gene Name: chromosome 5 open reading frame 38
  ENSP ID: ENSP00000426001
MVAPAARVFLRAVRAALTSTVPDLLCLLARGSPRGLASGRLPLAVHSAQHGPGSGAPWLRIARRALRFVLSKHWGDDCYLTNRLWQDLKPPSHVENGQELRLAPPVQWALQVQGNQLQTAVLCLRMAPPEPAGSR

SEQ ID NO: 16633 - protein, 135 aa, Homo sapiens; identical to SEQ ID NO: 16632
  Payload ID: 3336
  Gene Symbol: C5orf38
  Gene Name: chromosome 5 open reading frame 38
  ENSP ID: ENSP00000426967

SEQ ID NO: 16634 - protein, 3197 aa, Homo sapiens
  Payload ID: 3337
  Gene Symbol: C5orf42
  Gene Name: chromosome 5 open reading frame 42
  Uniprot ID: Q9H799
  ENSP ID: ENSP00000389014
MEIRLEILTSTGIKQKKPWPRVSWLGKEKEAVFLLDDKFINEINLLSGKIKKKIPSLQPFLKDVIVLTTSSNDAWLAGVLTTGELFLWNKDQDCLKTIPITEKPKEMIKATVASSLRLYLYVSGNGKRIVLITPSGCIFLWEYLELKNILSSKSLSLAGRWSQVIPEEAVLLPSTEDKEAVVNAVFIKNELFGDCCLCSFTFYSGECLKLTFLAIRWHENVFTSVRSLPYHVHWAQQDCHLCSLIPKCESVKSRGALISAFSRDGLTLAVTLNQKDPKATQVLFINTLNFVTLCGSLKGCSNKSPVVPATLIRSYWVGDISWTHDSLFLACMLKRGSLVLLTCQGELLTLITFGCSIEFGPAEFIPLHPLITYRPQQFTFQDSNNSVDSSASDSDPMRQRFSIKAHSRLPYLVISDGYMVTTLRFLDSLSPSVHMRSLLLDSTQRLEKIYQSVILSKPKGKGLNLRSLNSLRSSLLEHQGNESSADFTVPKFLQAEETINENAADFQDFEAEETNEGRHFPDNLCPFWNKRDDVLCSSMKEGRLEFASMFDTIHAKDDSEETDRTITELHSIQKSLLAAWTIGISKTVTEKNLMLNYIVVCITHFFYILQFIKCPFPKLDLVLSKSSRHNAWILCIFQLFHQCLSIHYWDIRYKQDVGHLIKLTSNTVKLLLTQQQKGQLFSEKLLACFYLLKMVADNLNGVYILQPEVISASADGSKITAQDSLVVPIFQMFQDSGFQKNWSWNSFFKIHPQVVNPVQQPGHRLLILWRILYKKTLWYQAQLNRRVPEADSQLTEKMTHEASTVKSLLCHLQANLQSTGDCLNQTLELKSINGEECFLLGSYEKSVQLWKKALQEIEEKGGRRTYFLQIRYYLSLLYCHLYSYNLNDAQGLCDQLAREILRWSQLPVKENKDFSGAAKSHFECGMVGGVHPEAAVRVVQSMARFMAAYFTNQQLCILPPHHVNVLPPLHIKTEQSFRLIPLQHSKVASVVRDQNLSNVWTVEYALELLFIGGLVPEAVWLAYKLGDWKTSVSIGVAFQLFCKRDSNFMRSKKKSLNLPLRMTPAQIFQEKLQCVLGQPASLEAKNEMGSKYKQFTDPIEEEDANLLFGSVQEVLKASVMADADILSETFQLLIDSAKDFSKRLWGLVPFGLYLPAPPLYCPQPAILSEEDGDDLLLKAEKNNRQKVSGILQRVLLLFRAAQCSFPVAQWYILQLRWARKVMQKIRMKGSLPSLSPFPQSLLNYCKGGIAFFRPGAAGDHKLDEVSIRAIGCFRELCALCWMLHVRDKLSYSCRQYQKARENVKGEKDLEVEFDSCMIEHCLSAVEWAYRMLPFSRFFNMEELIQDIILSLIGELPPIRKVAEIFVKAFPYPEDVRVPLRDKYHSLHQRLRHCVVKGPQTEEMMSVVMHSIQKVRVKALKRVQRNIGSFEVNIWEPIEEEKPDEAPGVDRYSLGTSLSRSTLTELGDSVVHSDADTFSEALSVEEKSRINIYQRNAPNHMELTSIHKPTDKRKMCNQKENPTKKEDHEKLSQNTLPVIGVWEFERDDDEYIKFLDLFLSYILERDLPYSRDADIPFLTSFSGKLREHELNSLLFDVHTTLKRHQSKTKSQNVFRAGSCFVVAPESYESEKSSSLNDEYGMHLENQKLSSSVLVNQGIKPFLQYPSNEVNKNEGMSGLFGLKQRSIYKIQDDTREKCLIQRSSNHIFWTPKSIKTRRCIFKAIQCNDINPQEDLPLALNTFGSIGRLLEWMIRWSNRRLLCDSGITESSSEYSPVIRVKTSTAAILTSLWLLEQPYFATYKAKNAIIKMVENRDTGCQIGPNIERESKSDAGGSVAVATPGGTEERNGQNKSCQNILNRMPTEAKNPDIKEINDDIISITHNTKKEFIDIDENLLEVEAFTEEEMDMHISDYEEDIEESVGGFRSPSLAICMMTLPQQLEEEFTEEVQCQREEPLETIMEEKSTEQKGMIEAFSHPGHTTPQSMQVDTSSEISSAQISTYKEKSSSVPLLISNGVNVASQPPAPTPQKTQRNEFTAQLPDCSESVRQMLQDEMFKLVQLQQINFMSLMQIVGSSFANLPDTQQLVQQSQSVHLGESQESNLRGCGDVEDSNKNLKERFFIKPQSMGENAREPRKNSPHCHEGTIPSGQNSTGNVQNVPHGSIPLCQLNGQPRKKGPIPSSQNLPSTSFYPAPAGNTHLYLLSTPSVVQKAPRLIPHAKTFSPGDGFPLLQFKSKQEFQPLFLHTGSIPQVPFRPLPQPREAWGLSDSFQPALPQRAAQTTPASHLNVSQYNTEARKKEVEQKTWAETVITEIPNHVNLDQYVGQENLTPQQDSSVFIKPEKLFDVKPGTLEISPHHSFGLPLLYLPLKPPNMFPSTSRASITVPSTPIQPIAEERKYPRLSLLHSHLSPENRCKKTQLIPLENLIAFKQSQQKLTHNLFEQGDAGHLQLLKVKIEPPEVRQGKDSKKRQRRRAEKELQEKRCEKLRRKPNVTFRPENSIINNDDSEIIKKPKEQQEHCGSHPLDDFDVPFEMLQDDNTSAGLHFMASVKKKAIGSQDASTNTDPEHEPLTAPQLLVPDVYLNLKLSSEMSEKPWSPSIPHTVTNLELPVREEPSNDNVIKQQSDHLAVPSSAELHYMAASVTNAVPPHNFKSQGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPGMNSSDELCESVSVHPLQMTGLTDIADIIDDLIIKDGVSSEELGLTEQAMGTSRIQHYSGRHSQRTDKERREIQAWMKRKRKERMAKYLNELAEKRGQEHDPFCPRSNPLYMTSREIRLRQKMKHEKDRLLLSEHYSRRISQAYGLMNELLSESVQLPTLPQKPLPNKPSPTQSSSCQHCPSPRGENQHGHSFLINRPGKVKYMSKPSYIHKRKSFGQPQGSPWPHGTATFTIQKKAGGAKAAVRKATQSPVTFQKGSNAPCHSLQHTKKHGSAGLAPQTKQVCVEYEREETVVSPWTIPSEIHKILHESHNSLLQDLSPTEEEEPEHPFGVGGVDSVSESTGSILSKLDWNAIEDMVASVEDQGLSVHWALDL

SEQ ID NO: 16635 - protein, 3197 aa, Homo sapiens; identical to SEQ ID NO: 16634
  Payload ID: 3337
  Gene Symbol: C5orf42
  Gene Name: chromosome 5 open reading frame 42
  Uniprot ID: Q9H799
  ENSP ID: ENSP00000421690

SEQ ID NO: 16636 - protein, 2263 aa, Homo sapiens
  Payload ID: 3337
  Gene Symbol: C5orf42
  Gene Name: chromosome 5 open reading frame 42
  ENSP ID: ENSP00000424223
QQLCILPPHHVNVLPPLHIKTEQSFRLIPLQHSKVASVVRDQNLSNVWTVEYALELLFIGGLVPEAVWLAYKLGDWKTSVSIGVAFQLFCKRDSNFMRSKKKSLNLPLRMTPAQIFQEKLQCVLGQPASLEAKNEMGSKYKQFTDPIEEEDANLLFGSVQEVLKASVMADADILSETFQLLIDSAKDFSKRLWGLVPFGLYLPAPPLYCPQPAILSEEDGDDLLLKAEKNNRQKVSGILQRVLLLFRAAQCSFPVAQWYILQLRWARKVMQKIRMKGSLPSLSPFPQSLLNYCKGGIAFFRPGAAGDHKLDEVSIRAIGCFRELCALCWMLHVRDKLSYSCRQYQKARENVKGEKDLEVEFDSCMIEHCLSAVEWAYRMLPFSRFFNMEELIQDIILSLIGELPPIRKVAEIFVKAFPYPEDVRVPLRDKYHSLHQRLRHCVVKGPQTEEMMSVVMHSIQKVRVKALKRVQRNIGSFEVNIWEPIEEEKPDEAPGVDRYSLGTSLSRSTLTELGDSVVHSDADTFSEALSVEEKSRINIYQRNAPNHMELTSIHKPTDKRKMCNQKENPTKKEDHEKLSQNTLPVIGVWEFERDDDEYIKFLDLFLSYILERDLPYSRDADIPFLTSFSGKLREHELNSLLFDVHTTLKRHQSKTKSQNVFRAGSCFVVAPESYESEKSSSLNDEYGMHLENQKLSSSVLVNQGIKPFLQYPSNEVNKNEGMSGLFGLKQRSIYKIQDDTREKCLIQRSSNHIFWTPKSIKTRRCIFKAIQCNDINPQEDLPLALNTFGSIGRLLEWMIRWSNRRLLCDSGITESSSEYSPVIRVKTSTAAILTSLWLLEQPYFATYKAKNAIIKMVENRDTGCQIGPNIERESKSDAGGSVAVATPGGTEERNGQNKSCQNILNRMPTEAKNPDIKEINDDIISITHNTKKEFIDIDENLLEVEAFTEEEMDMHISDYEEDIEESVGGFRSPSLAICMMTLPQQLEEEFTEEVQCQREEPLETIMEEKSTEQKGMIEAFSHPGHTTPQSMQVDTSSEISSAQISTYKEKSSSVPLLISNGVNVASQPPAPTPQKTQRNEFTAQLPDCSESVRQMLQDEMFKLVQLQQINFMSLMQIVGSSFANLPDTQQLVQQSQSVHLGESQESNLRGCGDVEDSNKNLKERFFIKPQSMGENAREPRKNSPHCHEGTIPSGQNSTGNVQNVPHGSIPLCQLNGQPRKKGPIPSSQNLPSTSFYPAPAGNTHLYLLSTPSVVQKAPRLIPHAKTFSPGDGFPLLQFKSKQEFQPLFLHTGSIPQVPFRPLPQPREAWGLSDSFQPALPQRAAQTTPASHLNVSQYNTEARKKEVEQKTWAETVITEIPNHVNLDQYVGQENLTPQQDSSVFIKPEKLFDVKPGTLEISPHHSFGLPLLYLPLKPPNMFPSTSRASITVPSTPIQPIAEERKYPRLSLLHSHLSPENRCKKTQLIPLENLIAFKQSQQKLTHNLFEQGDAGHLQLLKVKIEPPEVRQGKDSKKRQRRRAEKELQEKRCEKLRRKPNVTFRPENSIINNDDSEIIKKPKEQQEHCGSHPLDDFDVPFEMLQDDNTSAGLHFMASVKKKAIGSQDASTNTDPEHEPLTAPQLLVPDVYLNLKLSSEMSEKPWSPSIPHTVTNLVGHTYINVIDIEANDLLQELPVREEPSNDNVIKQQSDHLAVPSSAELHYMAASVTNAVPPHNFKSQGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPGMNSSDELCESVSVHPLQMTGLTDIADIIDDLIIKDGVSSEELGLTEQAMGTSRIQHYSGRHSQRTDKERREIQAWMKRKRKERMAKYLNELAEKRGQEHDPFCPRSNPLYMTSREIRLRQKMKHEKDRLLLSEHYSRRISQAYGLMNELLSESVQLPTLPQKPLPNKPSPTQSSSCQHCPSPRGENQHGHSFLINRPGKVKYMSKPSYIHKRKSFGQPQGSPWPHGTATFTIQKKAGGAKAAVRKATQSPVTFQKGSNAPCHSLQHTKKHGSAGLAPQTKQVCVEYEREETVVSPWTIPSEIHKILHESHNSLLQDLSPTEEEEPEHPFGVGGVDSVSESTGSILSKLDWNAIEDMVASVEDQGLSVHWALDL

SEQ ID NO: 16637 - protein, 1889 aa, Homo sapiens
  Payload ID: 3337
  Gene Symbol: C5orf42
  Gene Name: chromosome 5 open reading frame 42
  ENSP ID: ENSP00000426337
QQLCILPPHHVNVLPPLHIKTEAVWLAYKLGDWKTSVSIGVAFQLFCKRDSNFMRSKKKSLNLPLRMTPAQIFQEKLQCVLGQPASLEAKNEMGSKYKQFTDPIEEEDANLLFGSVQEVLKASVMADADILSETFQLLIDSAKDFSKRLWGLVPFGLYLPAPPLYCPQPAILSEEDGDDLLLKAEKNNRQKVSGILQRVLLLFRAAQCSFPVAQWYILQLRWARKVMQKIRMKGSLPSLSPFPQSLLNYCKGGIAFFRPGAAGDHKLDEVSIRAIGCFRELCALCWMLHVRDKLSYSCRQYQKARENVKGEKDLEVEFDSCMIEHCLSAVEWAYRMLPFSRFFNMEELIQDIILSLIGELPPIRKVAEIFVKAFPYPEDVRVPLRDKYHSLHQRLRHCVVKGPQTEEMMSVVMHSIQKVRVKALKRVQRNIGSFEVNIWEPIEEEKPDEAPGVDRYSLGTSLSRSTLTELGDSVVHSDADTFSEALSVEEKSRINIYQRNAPNHMELTSIHKPTDKRKMCNQKENPTKKEDHEKLSQNTLPVIGVWEFERDDDEYIKFLDLFLSYILERDLPYSRDADIPFLTSFSGKLREHELNSLLFDVHTTLKRHQSKTKSQNVFRAGSCFVVAPESYESEKSSSLNDEYGMHLENQKLSSSVLVNQGIKPFLQYPSNEVNKNEGMSGLFGLKQRSIYKIQDDTREKCLIQRSSNHIFWTPKSIKTRRCIFKAIQCNDINPQEDLPLALNTFGSIGRLLEWMIRWSNRRLLCDSGITESSSEYSPVIRVKTSTAAILTSLWLLEQPYFATYKAKNAIIKMVENRDTGCQIGPNIERESKSDAGGSVAVATPGGTEERNGQNKSCQNILNRMPTEAKNPDIKEINDDIISITHNTKKEFIDIDENLLEVEAFTEEEMDMHISDYEDIEESVGGFRSPSLAICMMTLPQQLEEEFTEEVQCQREEPLETIMEEKSTEQKGMIEAFSHPGHTTPQSMQVDTSSEISSAQISTYKEKSSSVPLLISNGVNVASQPPAPTPQKTQRNEFTAQLPDCSESVRQMLQDEMFKLVQLQQINFMSLMQIVGSSFANLPDTQQLVQQSQSVHLGESQESNLRGCGDVEDSNKNLKERFFIKPQSMGENAREPRKNSPHCHEGTIPSGQNSTGNVQNVPHGSIPLCQLNGQPRKKGPIPSSQNLPSTSFYPAPAGNTHLYLLSTPSVVQKAPRLIPHAKTFSPGDGFPLLQFKSKQEFQPLFLHTGSIPQVPFRPLPQPREAWGLSDSFQPALPQRAAQTTPASHLNVSQYNTEARKKEVEQKTWAETVITEIPNHVNLDQYVGQENLTPQQDSSVFIKPEKLFDVKPGTLEISPHHSFGLPLLYLPLKPPNMFPSTSRASITVPSTPIQPIAEERKYPRLSLLHSHLSPENRCKKTQLIPLENLIAFKQSQQKLTHNLFEQGDAGHLQLLKVKIEPPEVRQGKDSKKRQRRRAEKELQEKRCEKLRRKPNVTFRPENSIINNDDSEIIKKPKEQQEHCGSHPLDDFDVPFEMLQDDNTSAGLHFMASVKKKAIGSQDASTNTDPEHEPLTAPQLLVPDVYLNLKLSSEMSEKPWSPSIPHTVTNLVGHTYINVIDIEANDLLQELPVREEPSNDNVIKQQSDHLAVPSSAELHYMAASVTNAVPPHNFKSQEVTPACLDGKSLRAGITEVKEPSVTSPTPSDIQQNKGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPVFQYIRSR

SEQ ID NO: 16638 - protein, 496 aa, Homo sapiens
  Payload ID: 3337
  Gene Symbol: C5orf42
  Gene Name: chromosome 5 open reading frame 42
  ENSP ID: ENSP00000473657
  MOD_RES (1)..(1): Any amino acid
XIPNHVNLDQYVGQENLTPQQDSSVFIKPEKLFDVKPGTLEISPHHSFGLPLLYLPLKPPNMFPSTSRASITVPSTPIQPIAEERKYPRLSLLHSHLSPENRCKKTQLIPLENLIAFKQSQQKLTHNLFEQGDAGHLQLLKVKIEPPEVRQGKDSKKRQRRRAEKELQEKRCEKLRRKPNVTFRPENSIINNDDSEIIKKPKEQQEHCGSHPLDDFDVPFEMLQDDNTSAGLHFMASVKKKAIGSQDASTNTDPEHEPLTAPQLLVPDVYLNLKLSSEMSEKPWSPSIPHTVTNLVGHTYINVIDIEANDLLQELPVREEPSNDNVIKQQSDHLAVPSSAELHYMAASVTNAVPPHNFKSQESANSSMDLFSKPAEVTPACLDGKSLRAGITEVKEPSVTSPTPSDIQQNKGLPKPEFRFKGQSTKSDSAEDYLLWKRLQGVSAACPAPSSAAHQLEHLSAKLQKIDEQLLAIQNIAENIEQDFPKPEMLDLHCDK

SEQ ID NO: 16639 - protein, 343 aa, Homo sapiens
  Payload ID: 3338
  Gene Symbol: C5orf45
  Gene Name: chromosome 5 open reading frame 45
  Uniprot ID: Q6NTE8
  ENSP ID: ENSP00000292586
MASLQRSRVLRCCSCRLFQAHQVKKSVKWTCKACGEKQSFLQAYGEGSGADCRRHVQKLNLLQGQVSELPLRSLEETVSASEEENVGHQQAGNVKQQEKSQPSESRWLKYLEKDSQELELEGTGVCFSKQPSSKMEEPGPRFSQDLPRKRKWSRSTVQPPCSRGVQDSGGSEVAWGPQKGQAGLTWKVKQGSSPCLQENSADCSAGELRGPGKELWSPIQQVTATSSKWAQFVLPPRKSSHVDSEQPRSLQRDPRPAGPAQAKQGTPRAQASREGLSRPTAAVQLPRATHPVTSGSERPCGKTSWDARTPWAEGGPLVLEAQNPRPTRLCDLFITGEDFDDDV

SEQ ID NO: 16640 - protein, 288 aa, Homo sapiens
  Payload ID: 3338
  Gene Symbol: C5orf45
  Gene Name: chromosome 5 open reading frame 45
  Uniprot ID: Q6NTE8
  ENSP ID: ENSP00000366130
MASLQRSRVLRCCSCRLFQAHQVKKSVKWTCKACGEKQSFLQEKSQPSESRWLKYLEKDSQELELEGTGVCFSKQPSSKMEEPGPRFSQDLPRKRKWSRSTVQPPCSRGVQDSGGSEVAWGPQKGQAGLTWKVKQGSSPCLQENSADCSAGELRGPGKELWSPIQQVTATSSKWAQFVLPPRKSSHVDSEQPRSLQRDPRPAGPAQAKQGTPRAQASREGLSRPTAAVQLPRATHPVTSGSERPCGKTSWDARTPWAEGGPLVLEAQNPRPTRLCDLFITGEDFDDDV

SEQ ID NO: 16641 - protein, 174 aa, Homo sapiens
  Payload ID: 3338
  Gene Symbol: C5orf45
  Gene Name: chromosome 5 open reading frame 45
  ENSP ID: ENSP00000427849
MASLQRSRVLRCCSCRLFQAHQVKKSVKWTCKACGEKQSFLQEKSQPSESRWLKYLEKDSQELELEGTGVCFSKQPSSKMEEPGPRFSQDLPRKRKWSRSTVQPPCSRGVQDSGGSEVAWGPQKGQAGLTWKVKQGSSPCLQENSADCSAGELRGPGKELWSPIQQDGYKEILF

SEQ ID NO: 16642 - protein, 93 aa, Homo sapiens
  Payload ID: 3338
  Gene Symbol: C5orf45
  Gene Name: chromosome 5 open reading frame 45
  ENSP ID: ENSP00000428081
MASLQRSRVLRCCSCRLFQAHQVKKSVKWTCKACGEKQSFLQVSPTKQKASGAQACSEPFQGVPACHSWDHPLSNRVPQTRSSCFRASCSFRK

SEQ ID NO: 16643 - protein, 192 aa, Homo sapiens
  Payload ID: 3338
  Gene Symbol: C5orf45
  Gene Name: chromosome 5 open reading frame 45
  ENSP ID: ENSP00000428460
MASLQRSRVLRCCSCRLFQAHQVKKSVKWTCKACGEKQSFLQAYGEGSGADCRRHVQKLNLLQGQVSELPLRSLEETVSASEEENVGHQQAGNVKQQEKSQPSESRWLKYLEKDSQELELEGTGVCFSKQPSSKMEEPGPRFSQDLPRKRKWSRSTVQPPCSRGVQDSGGSEVAWGPQKVSDKQFLSGPSDH

SEQ ID NO: 16644 - protein, 85 aa, Homo sapiens
  Payload ID: 3338
  Gene Symbol: C5orf45
  Gene Name: chromosome 5 open reading frame 45
  ENSP ID: ENSP00000429047
MASLQRSRVLRCCSCRLFQAHQVKKSVKWTCKACGEKQSFLQSSPDTELLLPSFLFLQEVKWMEQNLERLMVKALVLIVDAMSKS

SEQ ID NO: 16645 - protein, 209 aa, Homo sapiens
  Payload ID: 3338
  Gene Symbol: C5orf45
  Gene Name: chromosome 5 open reading frame 45
  ENSP ID: ENSP00000429107
MEEPGPRFSQDLPRKRKWSRSTVQPPCSRGVQDSGGSEVAWGPQKGQAGLTWKVKQGSSPCLQENSADCSAGELRGPGKELWSPIQQVTATSSKWAQFVLPPRKSSHVDSEQPRSLQRDPRPAGPAQAKQGTPRAQASREGLSRPTAAVQLPRATHPVTSGSERPCGKTSWDARTPWAEGGPLVLEAQNPRPTRLCDLFITGEDFDDDV

SEQ ID NO: 16646 - protein, 63 aa, Homo sapiens
  Payload ID: 3338
  Gene Symbol: C5orf45
  Gene Name: chromosome 5 open reading frame 45
  ENSP ID: ENSP00000429427
MASLQRSRVLRCCSCRLFQAHQVKKSVKWTCKACGEKQSFLQTVQSDSLLQVHRISFQANWKS

SEQ ID NO: 16647 - protein, 82 aa, Homo sapiens
  Payload ID: 3338
  Gene Symbol: C5orf45
  Gene Name: chromosome 5 open reading frame 45
  ENSP ID: ENSP00000429563
MASLQRSRVLRCCSCRLFQAHQVKKSVKWTCKACGEKQSFLQAYGEGSGADCRRHVQKLNLLQGQVSELPLRKNRSPQRVAG

SEQ ID NO: 16648 - protein, 113 aa, Homo sapiens
  Payload ID: 3338
  Gene Symbol: C5orf45
  Gene Name: chromosome 5 open reading frame 45
  ENSP ID: ENSP00000429651
MASLQRSRVLRCCSCRLFQAHQVKKSVKWTCKACGEKQSFLQAYGEGSGADCRRHVQKLNLLQGQVSELPLRSLEETVSASEEENVGHQQCRGAEGSWEGAMESHPAGYSHIL

SEQ ID NO: 16649 - protein, 85 aa, Homo sapiens; identical to SEQ ID NO: 16644
  Payload ID: 3338
  Gene Symbol: C5orf45
  Gene Name: chromosome 5 open reading frame 45
  ENSP ID: ENSP00000429835

SEQ ID NO: 16650 - protein, 94 aa, Homo sapiens
  Payload ID: 3338
  Gene Symbol: C5orf45
  Gene Name: chromosome 5 open reading frame 45
  ENSP ID: ENSP00000430187
MASLQRSRVLRCCSCRLFQAHQVKKSVKWTCKACGEKQSFLQSSPDTELLLPSFLFLQEVKWMEQNLERLFSQILCSKSIESHSKPTGRAESQL

SEQ ID NO: 16651 - protein, 229 aa, Homo sapiens
  Payload ID: 3338
  Gene Symbol: C5orf45
  Gene Name: chromosome 5 open reading frame 45
  ENSP ID: ENSP00000430298
MASLQRSRVLRCCSCRLFQAHQVKKSVKWTCKACGEKQSFLQAYGEGSGADCRRHVQKLNLLQGQVSELPLRSLEETVSASEEENVGHQQAGNVKQQEKSQPSESRWLKYLEKDSQELELEGTGVCFSKQPSSKMEEPGPRFSQDLPRKRKWSRSTVQPPCSRGVQDSGGSEVAWGPQKGQAGLTWKVKQGSSPCLQENSADCSAGELRGPGKELWSPIQQDGYKEILF

SEQ ID NO: 16652 - protein, 90 aa, Homo sapiens
  Payload ID: 3338
  Gene Symbol: C5orf45
  Gene Name: chromosome 5 open reading frame 45
  ENSP ID: ENSP00000430766
MASLQRSRVLRCCSCRLFQAHQVKKSVKWTCKACGEKQSFLQEKQPGWPRLTRMPTSGPVNWDWVSEERGWLTRLMVKALVLIVDAMSKS

SEQ ID NO: 16653 - protein, 82 aa, Homo sapiens; identical to SEQ ID NO: 16647
  Payload ID: 3338
  Gene Symbol: C5orf45
  Gene Name: chromosome 5 open reading frame 45
  ENSP ID: ENSP00000430814

SEQ ID NO: 16654 - protein, 51 aa, Homo sapiens
  Payload ID: 3338
  Gene Symbol: C5orf45
  Gene Name: chromosome 5 open reading frame 45
  ENSP ID: ENSP00000431019
MASLQRSRVLRCCSCRLFQAHQVKKSVKWTCKACGEKQSFLQVSRRNCQCQ

SEQ ID NO: 16655 - protein, 158 aa, Homo sapiens
  Payload ID: 3338
  Gene Symbol: C5orf45
  Gene Name: chromosome 5 open reading frame 45
  ENSP ID: ENSP00000482350
MEGETGSSPCLQENSADCSAGELRGPGKELWSPIQQVTATSSKWAQFVLPPRKSSHVDSEQPRSLQRDPRPAGPAQAKQGTPRAQASREGLSRPTAAVQLPRATHPVTSGSERPCGKTSWDARTPWAEGGPLVLEAQNPRPTRLCDLFITGEDFDDDV

SEQ ID NO: 16656 - protein, 87 aa, Homo sapiens
  Payload ID: 3339
  Gene Symbol: C5orf46
  Gene Name: chromosome 5 open reading frame 46
  Uniprot ID: Q6UWT4
  ENSP ID: ENSP00000315370
MAVSVLRLTVVLGLLVLFLTCYADDKPDKPDDKPDDSGKDPKPDFPKFLSLLGTEIIENAVEFILRSMSRSTGFMEFDDNEGKHSSK

SEQ ID NO: 16657 - protein, 72 aa, Homo sapiens
  Payload ID: 3339
  Gene Symbol: C5orf46
  Gene Name: chromosome 5 open reading frame 46
  Uniprot ID: Q6UWT4
  ENSP ID: ENSP00000425984
MAVSVLRLTVVLGLLVLFLTCYADDKPDKPDDKPDDSGKDPKPDFPKFLSLLGTEIIENAVEFILRSMSRST

SEQ ID NO: 16658 - protein, 176 aa, Homo sapiens
  Payload ID: 3340
  Gene Symbol: C5orf47
  Gene Name: chromosome 5 open reading frame 47
  Uniprot ID: Q569G3
  ENSP ID: ENSP00000340887
MAAAGRGREQDSARFVYVTRFGSHQCSGVLQLGGRGAQGLWGQGPGAGCRQEKPREAMAVAGVQGGSELPLGSQLRVPTTPGVEAAASASSQLRASRVQSGTRQSARAGLIQKDAAKKYDFPIPLNEASKIMKKKKKVLVWNRVYKVISRMLEENEKYRHRLKCQRLSSESSNYTR

SEQ ID NO: 16659 - protein, 147 aa, Homo sapiens
  Payload ID: 3341
  Gene Symbol: C5orf49
  Gene Name: chromosome 5 open reading frame 49
  Uniprot ID: A4QMS7
  ENSP ID: ENSP00000382708
MEDDEEETTASTLRGKPRPPPVSAQSAFSYIPPRRLDPKEHSYYYRPARTGIISLYDCIFKRRLDYDQKLHRDDREHAKSLGLHVNEEEQERPVGVLTSSVYGKRINQPIEPLNRDFGRANHVQADFYRKNDIPSLKEPGFGHIAPS

SEQ ID NO: 16660 - protein, 145 aa, Homo sapiens
  Payload ID: 3341
  Gene Symbol: C5orf49
  Gene Name: chromosome 5 open reading frame 49
  ENSP ID: ENSP00000426019
MEDDEEETTASTLRGKPRPPPVSAQSAFSYIPPRRLDPKEHSYYYRPARTGIISLYDCIFKRRLDYDQKLHRDDREHAKSLGLHVNEEERPVGVLTSSVYGKRINQPIEPLNRDFGRANHVQADFYRKNDIPSLKEPGFGHIAPS

SEQ ID NO: 16661 - protein, 294 aa, Homo sapiens
  Payload ID: 3342
  Gene Symbol: C5orf51
  Gene Name: chromosome 5 open reading frame 51
  Uniprot ID: A6NDU8
  ENSP ID: ENSP00000371061
MAAAVSSVVRRVEELGDLAQAHIQQLSEAAGEDDHFLIRASAALEKLKLLCGEEKECSNPSNLLELYTQAILDMTYFEENKLVDEDFPEDSSSQKVKELISFLSEPEILVKENNMHPKHCNLLGDELLECLSWRRGALLYMYCHSLTKRREWLLRKSSLLKKYLLDGISYLLQMLNYRCPIQLNEGVSFQDLDTAKLLSAGIFSDIHLLAMMYSGEMCYWGSKYCADQQPENHEVDTSVSGAGCTTYKEPLDFREVGEKILKKYVSVCEGPLKEQEWNTTNAKQILNFFHHRCN

SEQ ID NO: 16662 - protein, 152 aa, Homo sapiens
  Payload ID: 3342
  Gene Symbol: C5orf51
  Gene Name: chromosome 5 open reading frame 51
  ENSP ID: ENSP00000481500
MAAAVSSVVRRVEELGDLAQAHIQQLSEAAGEDDHFLIRASAALEKLKLLCGEEKECSNPSNLLELYTQAILDMTYFEENKLVDEDFPEDSSSQKVKELISFLSEPEILVKENNMHPKHCNLLGDELLECLSHFPLWLSQTSLLSLGPLPLP

SEQ ID NO: 16663 - protein, 159 aa, Homo sapiens
  Payload ID: 3343
  Gene Symbol: C5orf52
  Gene Name: chromosome 5 open reading frame 52
  Uniprot ID: A6NGY3
  ENSP ID: ENSP00000387027
MTQPTRPSVTCDQGSSTIGGTAAQATTSSSATSGSNYQRDRLGRRPEIGVGGQPQICFPRPRSAQQPVLFSLMNSSEAAMKKTLPKSHLSRVIIHDNRITQRIYEMEVSALEKTKKKISHYYEHLKKKFMTEQLRKLGRWREESVNSNRYLTFGIPPPV

SEQ ID NO: 16664 - protein, 126 aa, Homo sapiens
  Payload ID: 3344
  Gene Symbol: C5orf56
  Gene Name: chromosome 5 open reading frame 56
  Uniprot ID: Q8N8D9
  ENSP ID: ENSP00000338228
MDSLAAGELNASHQPWVPEFVAYWRKTHQGNLQTLLLHWLLLCSCLHHLYNASCHPAFPVEYSHAVCCLQPRFWKEMSPFSSSSTTHLFSKCFFYTCLCWAWQQCSSEQNHQPCSHAAYNQVERQT

SEQ ID NO: 16665 - protein, 80 aa, Homo sapiens
  Payload ID: 3344
  Gene Symbol: C5orf56
  Gene Name: chromosome 5 open reading frame 56
  ENSP ID: ENSP00000368230
MDSLAAGELNASHQPWVPEFVAYWRKTHQAYATLCPLAKEAQLRPRSVPAQQSYRRPEAPSCSLLLYRRHAAKQMCRDTT

SEQ ID NO: 16666 - protein, 117 aa, Homo sapiens
  Payload ID: 3344
  Gene Symbol: C5orf56
  Gene Name: chromosome 5 open reading frame 56
  Uniprot ID: Q8N8D9
  ENSP ID: ENSP00000368236
MDSLAAGELNASHQPWVPEFVAYWRKTHQDHLCSLHSRAFGLLDARVTWALRRAPEPVPGKDRLLLAAFPAEASPVDTASVSVYGRAPRYMHKGVKKCVCTPVSKNSTAWLLLGGIS

SEQ ID NO: 16667 - protein, 37 aa, Homo sapiens
  Payload ID: 3344
  Gene Symbol: C5orf56
  Gene Name: chromosome 5 open reading frame 56
  ENSP ID: ENSP00000385513
MDSLAAGELNASHQPWVPEFVAYWRKTHQAPNSTVNG

SEQ ID NO: 16668 - protein, 126 aa, Homo sapiens; identical to SEQ ID NO: 16664
  Payload ID: 3344
  Gene Symbol: C5orf56
  Gene Name: chromosome 5 open reading frame 56
  Uniprot ID: Q8N8D9
  ENSP ID: ENSP00000481774

SEQ ID NO: 16669 - protein, 115 aa, Homo sapiens
  Payload ID: 3345
  Gene Symbol: C5orf63
  Gene Name: chromosome 5 open reading frame 63
  Uniprot ID: A6NC05
  ENSP ID: ENSP00000453964
MLWFQGNSMQLARSSFGLFLRNCSASKTTLPVLTLFTKDPCPLCDEAKEVLKPYENRFILQEVNITLPENSVWYERYKFDIPVFHLNGQFLMMHRVNTSKLEKQLLKLEQQSTGG

SEQ ID NO: 16670 - protein, 138 aa, Homo sapiens
  Payload ID: 3345
  Gene Symbol: C5orf63
  Gene Name: chromosome 5 open reading frame 63
  Uniprot ID: A6NC05
  ENSP ID: ENSP00000454153
MLWFQGNSMQLARSSFGLFLRNCSASKTTLPVLTLFTKDPCPLCDEAKEVLKPYENRQPYKDQKLPGTRRRRSPSSPSHPHMASQSGKRYNLTLNQVLSFDYDMGLDAPKTISSDCGAFYCLRMFKSPDMTCCFYPKQ

SEQ ID NO: 16671 - protein, 55 aa, Homo sapiens
  Payload ID: 3345
  Gene Symbol: C5orf63
  Gene Name: chromosome 5 open reading frame 63
  ENSP ID: ENSP00000475157
MLWFQGNSMQLARSSFGLFLRNCSASKTTLPVLTLFTKEFLSTRSLFACCHPCKM

SEQ ID NO: 16672 - protein, 59 aa, Homo sapiens
  Payload ID: 3345
  Gene Symbol: C5orf63
  Gene Name: chromosome 5 open reading frame 63
  ENSP ID: ENSP00000475415
MLWFQGNSMQLARSSFGLFLRNCSASKTTLPVLTLFTKDPCPLCDEAKEVLKPYENRVI

SEQ ID NO: 16673 - protein, 57 aa, Homo sapiens
  Payload ID: 3345
  Gene Symbol: C5orf63
  Gene Name: chromosome 5 open reading frame 63
  ENSP ID: ENSP00000475733
KTTLPVLTLFTKDPCPLCDEAKEVLKPYENRFLMMHRVNTSKLEKQLLKLEQQSTGG

SEQ ID NO: 16674 - protein, 138 aa, Homo sapiens; identical to SEQ ID NO: 16670
  Payload ID: 3345
  Gene Symbol: C5orf63
  Gene Name: chromosome 5 open reading frame 63
  Uniprot ID: A6NC05
  ENSP ID: ENSP00000475810

SEQ ID NO: 16675 - protein, 89 aa, Homo sapiens
  Payload ID: 3345
  Gene Symbol: C5orf63
  Gene Name: chromosome 5 open reading frame 63
  ENSP ID: ENSP00000476160
MLWFQGNSMQLARSSFGLFLRNCSASKTTLPVLTLFTKDPCPLCDEAKEVLKPYENRRSTSQSLGNAIYRKKVLHSCCCPGGLNFLMKE

SEQ ID NO: 16676 - protein, 127 aa, Homo sapiens
  Payload ID: 3346
  Gene Symbol: C5orf67
  Gene Name: chromosome 5 open reading frame 67
  Uniprot ID: F2Z3F1
  ENSP ID: ENSP00000406718
MKRIFYKHRKRRAPVFKEPEHGYQSLPELVLVPAQPLVCLGDYRTPDPGGLFPWSLRLMMPGAWTKLPGDGGSVPEKGKHGILGAQGQEHPGLNVSSPFSSPWTCYLSGHQPQNNNSPELQVKEILL

SEQ ID NO: 16677 - protein, 117 aa, Homo sapiens
  Payload ID: 3346
  Gene Symbol: C5orf67
  Gene Name: chromosome 5 open reading frame 67
  ENSP ID: ENSP00000480926
RRAPVFKEPEHGYQSLPELVLVPAQPLVCLGDYRTPDPGGLFPWSLRLMMPGAWTKLPGDGGSVPEKGKHGILGAQGQEHPGLNVSSPFSSPWTCYLSGHQPQNNNSPELQVKEILL

SEQ ID NO: 16678 - protein, 139 aa, Homo sapiens
  Payload ID: 3347
  Gene Symbol: C6orf1
  Gene Name: chromosome 6 open reading frame 1
  ENSP ID: ENSP00000334260
MTQLRNCMRLSRSCSLTWETPRWYMAGRVATSTSGCHCWMSRRDLTPLPHPSEPGVLDCLGPCHLLPLLSPGSPCWVLGLHFSLHPPSAASASHALTITSLPPGLLPFVGVELTAHPQALMGRGFPSGMGAAGRHLCFL

SEQ ID NO: 16679 - protein, 159 aa, Homo sapiens
  Payload ID: 3347
  Gene Symbol: C6orf1
  Gene Name: chromosome 6 open reading frame 1
  Uniprot ID: Q86T20
  ENSP ID: ENSP00000378441
MYRRKSGWTGCAITCSPCTAMTQLRNCMRLSRSCSLTWETPRWYMAGRVATSTSGCHCWMSRRDLTPLPHPSEPGVLDCLGPCHLLPLLSPGSPCWVLGLHFSLHPPSAASASHALTITSLPPGLLPFVGVELTAHPQALMGRGFPSGMGAAGRHLCFL

SEQ ID NO: 16680 - protein, 139 aa, Homo sapiens; identical to SEQ ID NO: 16678
  Payload ID: 3347
  Gene Symbol: C6orf1
  Gene Name: chromosome 6 open reading frame 1
  ENSP ID: ENSP00000387460

SEQ ID NO: 16681 - protein, 159 aa, Homo sapiens; identical to SEQ ID NO: 16679
  Payload ID: 3347
  Gene Symbol: C6orf1
  Gene Name: chromosome 6 open reading frame 1
  Uniprot ID: Q86T20
  ENSP ID: ENSP00000417604

SEQ ID NO: 16682 - protein, 159 aa, Homo sapiens; identical to SEQ ID NO: 16679
  Payload ID: 3347
  Gene Symbol: C6orf1
  Gene Name: chromosome 6 open reading frame 1
  Uniprot ID: Q86T20
  ENSP ID: ENSP00000418062

SEQ ID NO: 16683 - protein, 159 aa, Homo sapiens; identical to SEQ ID NO: 16679
  Payload ID: 3347
  Gene Symbol: C6orf1
  Gene Name: chromosome 6 open reading frame 1
  Uniprot ID: Q86T20
  ENSP ID: ENSP00000418884

SEQ ID NO: 16684 - protein, 561 aa, Homo sapiens
  Payload ID: 3348
  Gene Symbol: C6orf10
  Gene Name: chromosome 6 open reading frame 10
  ENSP ID: ENSP00000364146
MTVLEITLAVILTLLGLAILAILLTRWARCKQSEMYISRYSSEQSARLLDYEDGRGSRHAYSTQSGNLCFQRSKRDYTPSTNSLVSMASKFSLGQTELILLLMCFILALSRSSIGSIKCLQTTEEPPSRTAGAMMQFTAPIPGATGPIKLSQKTIVQTPGPIVQYPGSNAGPPSAPRGPPMAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16685 - protein, 562 aa, Homo sapiens
  Payload ID: 3348
  Gene Symbol: C6orf10
  Gene Name: chromosome 6 open reading frame 10
  Uniprot ID: Q5SRN2
  ENSP ID: ENSP00000364155
MTVLEITLAVILTLLGLAILAILLTRWARCKQSEMYISRYSSEQSARLLDYEDGRGSRHAYSTQSDTSYDNRERSKRDYTPSTNSLALSRSSIALPQGSMSSIKCLQTTEEPPSRTAGAMMQFTAPIPGATGPIKLSQKTIVQTPGPIVQYPGSNVRSHPHTITGPPSAPRGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16686 - protein, 563 aa, Homo sapiens
  Payload ID: 3348
  Gene Symbol: C6orf10
  Gene Name: chromosome 6 open reading frame 10
  Uniprot ID: Q5SRN2
  ENSP ID: ENSP00000372611
MTVLEITLAVILTLLGLAILAILLTRWARCKQSEMYISRYSSEQSARLLDYEDGRGSRHAYSTQSDTSYDNRERSKRDYTPSTNSLVSMASKFSLGQTELILLLMCFILALSRSSIGSIKCLQTTEEPPSRTAGAMMQFTAPIPGATGPIKLSQKTIVQTPGPIVQYPGSNAGPPSAPRGPPMAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16687 - protein, 562 aa, Homo sapiens
  Payload ID: 3348
  Gene Symbol: C6orf10
  Gene Name: chromosome 6 open reading frame 10
  ENSP ID: ENSP00000372749
MTVLEITLAVILTLLGLAILAILLTRWARRKQSEMYISRYSSEQSARLLDYEDGRGSRHAYSTQSDTSYDNRERSKRDYTPSTNSLALSRSSIALPQGSMSSIKCLQTTEEPPSRTAGAMMQFTAPIPGATGPIKLSQKTIVQTLGPIVQYPGSNVRSHPHTITGPPSAPRGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16688 - protein, 563 aa, Homo sapiens
  Payload ID: 3348
  Gene Symbol: C6orf10
  Gene Name: chromosome 6 open reading frame 10
  Uniprot ID: Q5SRN2
  ENSP ID: ENSP00000382654
MTVLEITLAVILTLLGLAILAILLTRWARRKQSEMYISRYSSEQSARLLDYEDGRGSRHAYSTQSDTSYDNRERSKRDYTPSTNSLVSMASKFSLGQTELILLLMCFILALSRSSIGSIKCLQTTEEPPSRTAGAMMQFTAPIPGATGPIKLSQKTIVQTLGPIVQYPGSNAGPPSAPRGPPMAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16689 - protein, 193 aa, Homo sapiens
  Payload ID: 3348
  Gene Symbol: C6orf10
  Gene Name: chromosome 6 open reading frame 10
  ENSP ID: ENSP00000390018
MTVLEITLAVILTLLGLAILAILLTRWARRKQSEMHISRYSSEQSARLLDYEDGRGSRHAYSTQSDTSCDNRERSKRDYTPSTNSLVSMASKFSLGQTELILLLMCFILALSRSSIGSIKCLQTTEELPSRTAGAMMQFTAPIPGATGPIKLSQKTIVQTPGPIVQYPGPNAGPPSAPRGPPMAPIIISQRTA

SEQ ID NO: 16690 - protein, 562 aa, Homo sapiens
  Payload ID: 3348
  Gene Symbol: C6orf10
  Gene Name: chromosome 6 open reading frame 10
  ENSP ID: ENSP00000393107
MTVLEITLAVILTLLGLAILAILLTRWARRKQSEMYISRYSSEQSARLLDYEDGRGSRHAYSTQSDTSYDNRERSKRDYTPSTNSLALSRSSIALPQGSMSSIKCLQTTEEPPSRTAGAMMQFTAPIPGATGPIKLSQKTIVQTLGPIVQYPGSNVRSHPHTITGPPSAPRGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSVPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16691 - protein, 192 aa, Homo sapiens
  Payload ID: 3348
  Gene Symbol: C6orf10
  Gene Name: chromosome 6 open reading frame 10
  ENSP ID: ENSP00000400272
MTVLEITLAVILTLLGLAILAILLTRWARRKQSEMHISRYSSEQSARLLDYEDGRGSRHAYSTQSDTSCDNRERSKRDYTPSTNSLALSRSSIALPQGSMSSIKCLQTTEELPSRTAGAMMQFTAPIPGATGPIKLSQKTIVQTPGPIVQYPGPNVRSHPHTITGPPSAPRGPPMAPIIISQRTASQLAAPI

SEQ ID NO: 16692 - protein, 563 aa, Homo sapiens
  Payload ID: 3348
  Gene Symbol: C6orf10
  Gene Name: chromosome 6 open reading frame 10
  ENSP ID: ENSP00000400675
MTVLEITLAVILTLLGLAILAILLTRWARRKQSEMYISRYSSEQSARLLDYEDGRGSRHAYSTQSDTSYDNRERSKRDYTPSTNSLVSMASKFSLGQTELILLLMCFILALSRSSIGSIKCLQTTEEPPSRTAGAMMQFTAPIPGATGPIKLSQKTIVQTLGPIVQYPGSNAGPPSAPRGPPMAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSVPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16693 - protein, 563 aa, Homo sapiens
  Payload ID: 3348
  Gene Symbol: C6orf10
  Gene Name: chromosome 6 open reading frame 10
  ENSP ID: ENSP00000406760
MTVLEITLAVILTLLGLAILAILLTRWARRKQSEMYISRYSSEQSARLLDYEDGRGSRHAYSTQSDTSYDNRERSKRDYTPSTNSLVSMASKFSLGQTELILLLMCFILALSRSSIGSIKCLQTTEEPPSRTAGAMMQFTAPIPGATGPFKLSQKTIVQTLGPIVQYPGSNAGPPSAPRGPPMAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSVPQGQGAQIKKSVSDVPRGQESQVKKSESGVPKGQEAQVTKSGLVVLKGQEAQVEKSEMGVPRRQESQVKKSQSGVSKGQEAQVKQRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16694 - protein, 563 aa, Homo sapiens
  Payload ID: 3348
  Gene Symbol: C6orf10
  Gene Name: chromosome 6 open reading frame 10
  Uniprot ID: Q5SRN2
  ENSP ID: ENSP00000408514
MTVLEITLAVILTLLGLAILAILLTRWARRKQSEMHISRYSSEQSARLLDYEDGRGSRHAYSTQSDTSCDNRERSKRDYTPSTNSLVSMASKFSLGQTELILLLMCFILALSRSSIGSIKCLQTTEELPSRTAGAMMQFTAPIPGATGPIKLSQKTIVQTPGPIVQYPGPNAGPPSAPRGPPMAPIIISQRTARIPQVHTMDSSGKITLTPVVILTGYMDEELAKKPCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16695 - protein, 193 aa, Homo sapiens; identical to SEQ ID NO: 16689
  Payload ID: 3348
  Gene Symbol: C6orf10
  Gene Name: chromosome 6 open reading frame 10
  ENSP ID: ENSP00000410028

SEQ ID NO: 16696 - protein, 562 aa, Homo sapiens; identical to SEQ ID NO: 16685
  Payload ID: 3348
  Gene Symbol: C6orf10
  Gene Name: chromosome 6 open reading frame 10
  Uniprot ID: Q5SRN2
  ENSP ID: ENSP00000410514

SEQ ID NO: 16697 - protein, 468 aa, Homo sapiens
  Payload ID: 3348
  Gene Symbol: C6orf10
  Gene Name: chromosome 6 open reading frame 10
  ENSP ID: ENSP00000411164
MTVLEITLAVILTLLGLAILAILLTRWARCKQSEMYISRYSSEQSARLLDYEDGRGSRHAYSTQSERSKRDYTPSTNSLALSRSSIALPQGSMSSIKCLQTTEEPPSRTAGAMMQFTAPIPGATGPIKLSQKTIVQTPGPIVQYPGSNAGPPSAPRGPPMAPIIISQRTASQLAAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTECFRNKDTLIYHHPEA

SEQ ID NO: 16698 - protein, 192 aa, Homo sapiens; identical to SEQ ID NO: 16691
  Payload ID: 3348
  Gene Symbol: C6orf10
  Gene Name: chromosome 6 open reading frame 10
  ENSP ID: ENSP00000414408

SEQ ID NO: 16699 - protein, 562 aa, Homo sapiens
  Payload ID: 3348
  Gene Symbol: C6orf10
  Gene Name: chromosome 6 open reading frame 10
  ENSP ID: ENSP00000415507
MTVLEITLAVILTLLGLAILAILLTRWARRKQSEMHISRYSSEQSARLLDYEDGRGSRHAYSTQSDTSCDNRERSKRDYTPSTNSLALSRSSIALPQGSMSSIKCLQTTEELPSRTAGAMMQFTAPIPGATGPIKLSQKTIVQTPGPIVQYPGPNVRSHPHTITGPPSAPRGPPMAPIIISQRTASQLAAPIRIPQVHTMDSSGKITLTPVVILTGYMDEELAKKPCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16700 - protein, 563 aa, Homo sapiens; identical to SEQ ID NO: 16686
  Payload ID: 3348
  Gene Symbol: C6orf10
  Gene Name: chromosome 6 open reading frame 10
  Uniprot ID: Q5SRN2
  ENSP ID: ENSP00000415517

SEQ ID NO: 16701 - protein, 562 aa, Homo sapiens
  Payload ID: 3348
  Gene Symbol: C6orf10
  Gene Name: chromosome 6 open reading frame 10
  ENSP ID: ENSP00000416682
MTVLEITLAVILTLLGLAILAILLTRWARRKQSEMYISRYSSEQSARLLDYEDGRGSRHAYSTQSDTSYDNRERSKRDYTPSTNSLALSRSSIALPQGSMSSIKCLQTTEEPPSRTAGAMMQFTAPIPGATGPFKLSQKTIVQTLGPIVQYPGSNVRSHPHTITGPPSAPRGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSVPQGQGAQIKKSVSDVPRGQESQVKKSESGVPKGQEAQVTKSGLVVLKGQEAQVEKSEMGVPRRQESQVKKSQSGVSKGQEAQVKQRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16702 - protein, 561 aa, Homo sapiens
  Payload ID: 3348
  Gene Symbol: C6orf10
  Gene Name: chromosome 6 open reading frame 10
  Uniprot ID: Q5SRN2
  ENSP ID: ENSP00000431199
MTVLEITLAVILTLLGLAILAILLTRWARCKQSEMYISRYSSEQSARLLDYEDGRGSRHAYSTQSDTSYDNRERSKRDYTPSTNSLALSRSSIALPQGSMSSIKCLQTTEEPPSRTAGAMMQFTAPIPGATGPIKLSQKTIVQTPGPIVQYPGSNAGPPSAPRGPPMAPIIISQRTASQLAAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16703 - protein, 125 aa, Homo sapiens
  Payload ID: 3348
  Gene Symbol: C6orf10
  Gene Name: chromosome 6 open reading frame 10
  ENSP ID: ENSP00000432566
MTVLEITLAVILTLLGLAILAILLTRWARCKQSEMYISRYSSEQSARLLDYEDGRGSRHAYSTQSDTSYDNRERSKRDYTPSTNSLVSMASKFSLGQTELILLLMCFILALSRSSIALPQGSMMQ

SEQ ID NO: 16704 - protein, 132 aa, Homo sapiens
  Payload ID: 3348
  Gene Symbol: C6orf10
  Gene Name: chromosome 6 open reading frame 10
  ENSP ID: ENSP00000432814
MTVLEITLAVILTLLGLAILAILLTRWARCKQSEMYISRYSSEQSARLLDYEDGRDFSSQRSKRGRGSRHAYSTQSERSKRDYTPSTNSLALSRSSIALPQGSMSSIKCLQTTEEPPSRTAGAMMQFTAPIP

SEQ ID NO: 16705 - protein, 547 aa, Homo sapiens
  Payload ID: 3348
  Gene Symbol: C6orf10
  Gene Name: chromosome 6 open reading frame 10
  ENSP ID: ENSP00000435103
MTVLEITLAVILTLLGLAILAILLTRWARCKQSEMYISRYSSEQSARLLDYEDGRGSRHAYSTQSERSKRDYTPSTNSLALSRSSIALPQGSMSSIKCLQTTEEPPSRTAGAMMQFTAPIPGATGPIKLSQKTIVQTPGPIVQYPGSNAGPPSAPRGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16706 - protein, 561 aa, Homo sapiens; identical to SEQ ID NO: 16702
  Payload ID: 3348
  Gene Symbol: C6orf10
  Gene Name: chromosome 6 open reading frame 10
  Uniprot ID: Q5SRN2
  ENSP ID: ENSP00000448472

SEQ ID NO: 16707 - protein, 561 aa, Homo sapiens; identical to SEQ ID NO: 16684
  Payload ID: 3348
  Gene Symbol: C6orf10
  Gene Name: chromosome 6 open reading frame 10
  ENSP ID: ENSP00000449235

SEQ ID NO: 16708 - protein, 565 aa, Homo sapiens
  Payload ID: 3348
  Gene Symbol: C6orf10
  Gene Name: chromosome 6 open reading frame 10
  ENSP ID: ENSP00000449655
MTVLEITLAVILTLLGLAILAILLTRWARCKQSEMYISRYSSEQSARLLDYEDGRGSRHAYHKVTLHMITERISKRDYTPSTNSLALSRSSIALPQGSMSSIKCLQTTEEPPSRTAGAMMQFTAPIQPELQDLSSSLKKPLCKLQDLLYNWIQCQIASSHNHTVHLQHPGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISDEYTTRTGSPNKEKCVRCTKRTGQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRRQIQEGSTTKKWKSKDKFFKGP

SEQ ID NO: 16709 - protein, 547 aa, Homo sapiens; identical to SEQ ID NO: 16705
  Payload ID: 3348
  Gene Symbol: C6orf10
  Gene Name: chromosome 6 open reading frame 10
  ENSP ID: ENSP00000477696

SEQ ID NO: 16710 - protein, 561 aa, Homo sapiens
  Payload ID: 3348
  Gene Symbol: C6orf10
  Gene Name: chromosome 6 open reading frame 10
  ENSP ID: ENSP00000478475
MTVLEITLAVILTLLGLAILAILLTRWARRKQSEMHISRYSSEQSARLLDYEDGRGSRHAYSTQSDTSCDNRERSKRDYTPSTNSLALSRSSIALPQGSMSSIKCLQTTEELPSRTAGAMMQFTAPIPGATGPIKLSQKTIVQTPGPIVQYPGPNAGPPSAPRGPPMAPIIISQRTASQLAAPIIISQRTARIPQVHTMDSSGKITLTPVVILTGYMDEELAKKPCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16711 - protein, 563 aa, Homo sapiens; identical to SEQ ID NO: 16688
  Payload ID: 3348
  Gene Symbol: C6orf10
  Gene Name: chromosome 6 open reading frame 10
  ENSP ID: ENSP00000478762

SEQ ID NO: 16712 - protein, 547 aa, Homo sapiens
  Payload ID: 3348
  Gene Symbol: C6orf10
  Gene Name: chromosome 6 open reading frame 10
  ENSP ID: ENSP00000478814
MTVLEITLAVILTLLGLAILAILLTRWARRKQSEMYISRYSSEQSARLLDYEDGRGSRHAYSTQSERSKRDYTPSTNSLALSRSSIALPQGSMSSIKCLQTTEEPPSRTAGAMMQFTAPIPGATGPIKLSQKTIVQTLGPIVQYPGSNAGPPSAPRGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSVPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16713 - protein, 547 aa, Homo sapiens
  Payload ID: 3348
  Gene Symbol: C6orf10
  Gene Name: chromosome 6 open reading frame 10
  ENSP ID: ENSP00000479242
MTVLEITLAVILTLLGLAILAILLTRWARRKQSEMYISRYSSEQSARLLDYEDGRGSRHAYSTQSERSKRDYTPSTNSLALSRSSIALPQGSMSSIKCLQTTEEPPSRTAGAMMQFTAPIPGATGPIKLSQKTIVQTLGPIVQYPGSNAGPPSAPRGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16714 - protein, 547 aa, Homo sapiens
  Payload ID: 3348
  Gene Symbol: C6orf10
  Gene Name: chromosome 6 open reading frame 10
  ENSP ID: ENSP00000479509
MTVLEITLAVILTLLGLAILAILLTRWARRKQSEMHISRYSSEQSARLLDYEDGRGSRHAYSTQSERSKRDYTPSTNSLALSRSSIALPQGSMSSIKCLQTTEELPSRTAGAMMQFTAPIPGATGPIKLSQKTIVQTPGPIVQYPGPNAGPPSAPRGPPMAPIIISQRTASQLAAPIRIPQVHTMDSSGKITLTPVVILTGYMDEELAKKPCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16715 - protein, 563 aa, Homo sapiens; identical to SEQ ID NO: 16686
  Payload ID: 3348
  Gene Symbol: C6orf10
  Gene Name: chromosome 6 open reading frame 10
  Uniprot ID: Q5SRN2
  ENSP ID: ENSP00000480403

SEQ ID NO: 16716 - protein, 565 aa, Homo sapiens
  Payload ID: 3348
  Gene Symbol: C6orf10
  Gene Name: chromosome 6 open reading frame 10
  ENSP ID: ENSP00000480415
MTVLEITLAVILTLLGLAILAILLTRWARRKQSEMHISRYSSEQSARLLDYEDGRGSRHAYHKVTLHVITERISKRDYTPSTNSLALSRSSIALPQGSMSSIKCLQTTEELPSRTAGAMMQFTAPIQPELQDLSSSLKKPLCKLQDLLARVQQQCIVAIHTVLVHLQHPGPPMAPIIISQRTASQLAAPIRIPQVHTMDSSGKITLTPVVILTGYMDEELAKKPCSKIQILKCGGTARSQNSREENKEALKNDIIFTNSVESLKSAHIKEPEREGKGTDLEKDKIGMEVKVDSDAGIPKRQETQLKISDEYTTRTGSPNKEKCVRCTKRTGQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRRQIQEGSTTKKWKSKDKFFKGP

SEQ ID NO: 16717 - protein, 561 aa, Homo sapiens
  Payload ID: 3348
  Gene Symbol: C6orf10
  Gene Name: chromosome 6 open reading frame 10
  ENSP ID: ENSP00000480915
MTVLEITLAVILTLLGLAILAILLTRWARRKQSEMYISRYSSEQSARLLDYEDGRGSRHAYSTQSDTSYDNRERSKRDYTPSTNSLALSRSSIALPQGSMSSIKCLQTTEEPPSRTAGAMMQFTAPIPGATGPIKLSQKTIVQTLGPIVQYPGSNAGPPSAPRGPPMAPIIISQRTASQLAAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSVPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16718 - protein, 565 aa, Homo sapiens; identical to SEQ ID NO: 16708
  Payload ID: 3348
  Gene Symbol: C6orf10
  Gene Name: chromosome 6 open reading frame 10
  ENSP ID: ENSP00000482001

SEQ ID NO: 16719 - protein, 566 aa, Homo sapiens
  Payload ID: 3348
  Gene Symbol: C6orf10
  Gene Name: chromosome 6 open reading frame 10
  ENSP ID: ENSP00000482193
MTVLEITLAVILTLLGLAILAILLTRWARRKQSEMYISRYSSEQSARLLDYEDGRGSRHAYHKVTLHMITERISKRDYTPSTNSLALSRSSIALPQGSMSSIKCLQTTEEPPSRTAGAMMQFTAPIQPELQDLSSSLKKPLCKLQDIGYNTWVTDQIASSHNHTVHLQHPGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISDEYTTRTGSPNKEKCVRCTKRTGQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRRQIQEGSTTKKWKSKDKFFKGP

SEQ ID NO: 16720 - protein, 563 aa, Homo sapiens; identical to SEQ ID NO: 16692
  Payload ID: 3348
  Gene Symbol: C6orf10
  Gene Name: chromosome 6 open reading frame 10
  ENSP ID: ENSP00000482853

SEQ ID NO: 16721 - protein, 561 aa, Homo sapiens
  Payload ID: 3348
  Gene Symbol: C6orf10
  Gene Name: chromosome 6 open reading frame 10
  ENSP ID: ENSP00000483277
MTVLEITLAVILTLLGLAILAILLTRWARRKQSEMYISRYSSEQSARLLDYEDGRGSRHAYSTQSDTSYDNRERSKRDYTPSTNSLALSRSSIALPQGSMSSIKCLQTTEEPPSRTAGAMMQFTAPIPGATGPIKLSQKTIVQTLGPIVQYPGSNAGPPSAPRGPPMAPIIISQRTASQLAAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 16722 - protein, 566 aa, Homo sapiens
  Payload ID: 3348
  Gene Symbol: C6orf10
  Gene Name: chromosome 6 open reading frame 10
  ENSP ID: ENSP00000484784
MTVLEITLAVILTLLGLAILAILLTRWARRKQSEMYISRYSSEQSARLLDYEDGRGSRHAYHKVTLHMITERISKRDYTPSTNSLALSRSSIALPQGSMSSIKCLQTTEEPPSRTAGAMMQFTAPIQPELQDLSSSLKKPLCKLQDIGYNTWVTDQIASSHNHTVHLQHPGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISDECTTRTGSPNKEKCVRCTKRTGQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRRQIQEGSTTKKWKSKDKFFKGP

SEQ ID NO: 16723 - protein, 563 aa, Homo sapiens; identical to SEQ ID NO: 16686
  Payload ID: 3348
  Gene Symbol: C6orf10
  Gene Name: chromosome 6 open reading frame 10
  Uniprot ID: Q5SRN2
  ENSP ID: ENSP00000485011

SEQ ID NO: 16724 - protein, 224 aa, Homo sapiens
  Payload ID: 3349
  Gene Symbol: C6orf106
  Gene Name: chromosome 6 open reading frame 106
  ENSP ID: ENSP00000363133
MSFVEDVTIGEGESIPPDTQFVKTWRIQNSGAEAWPPGVCLKYVGGDQFGHVNMVMVRSLEPQEIADVSVQMCSPSRAGMYQGQWRMCTATGLYYGDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 16725 - protein, 298 aa, Homo sapiens
  Payload ID: 3349
  Gene Symbol: C6orf106
  Gene Name: chromosome 6 open reading frame 106
  Uniprot ID: Q9H6K1
  ENSP ID: ENSP00000363135
MEGMDVDLDPELMQKFSCLGTTDKDVLISEFQRLLGFQLNPAGCAFFLDMTNWNLQAAIGAYYDFESPNISVPSMSFVEDVTIGEGESIPPDTQFVKTWRIQNSGAEAWPPGVCLKYVGGDQFGHVNMVMVRSLEPQEIADVSVQMCSPSRAGMYQGQWRMCTATGLYYGDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 16726 - protein, 232 aa, Homo sapiens
  Payload ID: 3349
  Gene Symbol: C6orf106
  Gene Name: chromosome 6 open reading frame 106
  Uniprot ID: Q9H6K1
  ENSP ID: ENSP00000363138
MEGMDVDLDPELMQKFSCLGTTDKDVLISEFQRLLGFQLNPAGCAFFLDMTNWNLQAAIGAYYDFESPNISVPSMSFVEDVTIGEGESIPPDTQFVKTWRIQNSDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 16727 - protein, 469 aa, Homo sapiens
  Payload ID: 3350
  Gene Symbol: C6orf118
  Gene Name: chromosome 6 open reading frame 118
  Uniprot ID: Q5T5N4
  ENSP ID: ENSP00000230301
MAEEREPELYLKWKHCETPGVKTLCNLKHCETPGVKTLCNLKKLLNRLQKDHREDVYLYISGHLNPNKLYQPPETILQHWPNAHRPKGERASEVGEPPAGKVARMKEALAHFTIHTALVPSEAQDTPLFRYLNPQASLSHTSEEDFLPVEAVREGKEEKKGGPPGRGPPGWRRREELRLPDLKVLCYQEAGSRGTRDRHHYVSSYLAGATSADRYRMFLRFQKEVLAKQDLLKNDFTGSKAAAGHERKLQQELQKICTCSPQQFNRLHVFGKVFEDICNSSLIFGDLLKKVKDEYELYMATLLESQPAAQYEALLAQLKALGQRPVKTADMDLAREELRMLVTATKAALEQNDRLRSELEMEVALLQSAKERSESSEKHIIDENRLTLTEKVEKKRCEILSKWDEIQALEKEIKTTLVHTGISDITENRIKSIEHEAIQLETENMILKKKIKGPLEIYQGICKIRGNRR

SEQ ID NO: 16728 - protein, 191 aa, Homo sapiens
  Payload ID: 3351
  Gene Symbol: C6orf120
  Gene Name: chromosome 6 open reading frame 120
  Uniprot ID: Q7Z4R8
  ENSP ID: ENSP00000346931
MAAPRGRAAPWTTALLLLLASQVLSPGSCADEEEVPEEWVLLHVVQGQIGAGNYSYLRLNHEGKIVLRMRSLKGDADLYVSASSLHPSFDDYELQSATCGPDAVSIPAHFRRPVGIGVYGHPSHLESEFEMKVYYDGTVEQHPFGEAAYPADGADAGQKHAGAPEDASQEEESVLWTILISILKLVLEILF

SEQ ID NO: 16729 - protein, 1188 aa, Homo sapiens
  Payload ID: 3352
  Gene Symbol: C6orf132
  Gene Name: chromosome 6 open reading frame 132
  Uniprot ID: Q5T0Z8
  ENSP ID: ENSP00000341368
MKKKQTVQGTFSKLFGKKHTTTPSTSLYATNPPWIFTQEAPEEGTGGFDGIYYGDNRFNTVSESGTATLKARPRVRPLLTFLPLNAQENHGLAVPTPSVPDDFADKEVTGTSSLVNGNLRLYSSVGDLRPGQYGQDLLIPPPPPGPAPGPPQDISEPPGGSPLPSPPSTAPPPPPLLLEPPPPPSMAPPPPPVLEALSPPHTLSSPSIPTPPDFIPPAPPLAFLAPPPPPVPAPAPPAPASPHTVGTRLFPPGGVTKWKSDVALNGRQAEATRASPPRSPAEPKGSALGPNPEPHLTFPRSFKVPPPTPVRTSSIPVQEAQEAPRKEEGATKKAPSRLPLPPSFHIRPASQVYPDRAPEPDCPGELKATAPASPRLGQSQSQADERAGTPPPAPPLPPPAPPLPPPAPPLPPAAPPLPCAQKAAHPPAGFTKTPKSSSPALKPKPNPPSPENTASSAPVDWRDPSQMEKLRNELAAYLCGSRREDRFLSHRPGPTVAPQSKEGKKGPRLPEKETLLSLPAKDTPPGVPEKSLGGSSLTETEAAPSLTLPSVDYIPQDSPTPSVRQIRNELEARLSSAAEKEAKPSIGSLPPKPRLEGGRICENGADDDKLSKPVAKNLPPQSTTLLPTTSLQPKAMLGPAIPPKATPEPAIPPKATLWPATPPKATLGPATPLKATSGPTTPLKATSGPAIASTATTLPTTTSQLMAEKDSGPAGQPEKPASQEVSTPSQARGEGSPSEATRLPTQGARSSAAFPPKTSPGGGEVPCLYKPHCHQSSLSREVAVVMPTLARGGAAGPGEPVEVKEPPGLPAKPPASAQPTDELLRHPVTGEVVERGSPMALLLAARQRAQKGRSVGAALGRSSLPGSLRDHSHQAEASSDSIFHSQGTPNSFTVVPKLPKEAEKDSPLTTEIPNKWGPRLGRDAEGTELSRRHNWTKPEPQAPVAWERVAPSNLPQGHPLPKSFSSPPSPSNKREEEEEEFNFEVIPPPPEFSNDPEPPAPALQYLGRQSSPPRNNYSDLRQLPNAGPGAPPALGFSRFPAGARYAGAGGLERFSGGGRSLIKKRLYVGEPHRGPGLPHGGTGRSLSSPNCFGPQPGGPEMRRVNSAGRAPPGGLHAPRLSLEGAARGAAEAKHKAPGSADYGFAPAAGRSPYTTTRYGSPINTFTVRPGTRHPISYVCSGAHRKATS

SEQ ID NO: 16730 - protein, 99 aa, Homo sapiens
  Payload ID: 3352
  Gene Symbol: C6orf132
  Gene Name: chromosome 6 open reading frame 132
  Uniprot ID: Q5T0Z8
  ENSP ID: ENSP00000348941
MKKKQTVQGTFSKLFGKKHTTTPSTSLYATNPPWIFTQEAPEEGTGGFDGIYYGDNRFNTVSESGTATLKARPRVRPLLTFLPLTEFHSCCPGWSGTMA

SEQ ID NO: 16731 - protein, 496 aa, Homo sapiens
  Payload ID: 3353
  Gene Symbol: C6orf136
  Gene Name: chromosome 6 open reading frame 136
  Uniprot ID: Q5SQH8
  ENSP ID: ENSP00000293604
MYQPSRGAARRLGPCLRAYQARPQVSGGEEGGRRGGGERPSSKPVRGAERALGSAQAQRHPPPLPTCALQRVDRLGVAGAGGRRCRACRARTSVLPGLRAVRRGQGQAAGRVCVAPDSPRLPVPRGDLKGRGREIRSPAAAPSRSSPAQTRPAGRPQQPARLALGERSWQEGRPVCTRFGPLRPGWQDGHAPSRDGASRTPSGTEDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 16732 - protein, 181 aa, Homo sapiens
  Payload ID: 3353
  Gene Symbol: C6orf136
  Gene Name: chromosome 6 open reading frame 136
  Uniprot ID: Q5SQH8
  ENSP ID: ENSP00000365654
MYQPSRGAARRLGPCLRAYQARPQLPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 16733 - protein, 315 aa, Homo sapiens
  Payload ID: 3353
  Gene Symbol: C6orf136
  Gene Name: chromosome 6 open reading frame 136
  Uniprot ID: Q5SQH8
  ENSP ID: ENSP00000365656
MYQPSRGAARRLGPCLRAYQARPQDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 16734 - protein, 181 aa, Homo sapiens; identical to SEQ ID NO: 16732
  Payload ID: 3353
  Gene Symbol: C6orf136
  Gene Name: chromosome 6 open reading frame 136
  Uniprot ID: Q5SQH8
  ENSP ID: ENSP00000373074

SEQ ID NO: 16735 - protein, 315 aa, Homo sapiens; identical to SEQ ID NO: 16733
  Payload ID: 3353
  Gene Symbol: C6orf136
  Gene Name: chromosome 6 open reading frame 136
  Uniprot ID: Q5SQH8
  ENSP ID: ENSP00000373075

SEQ ID NO: 16736 - protein, 181 aa, Homo sapiens; identical to SEQ ID NO: 16732
  Payload ID: 3353
  Gene Symbol: C6orf136
  Gene Name: chromosome 6 open reading frame 136
  Uniprot ID: Q5SQH8
  ENSP ID: ENSP00000387592

SEQ ID NO: 16737 - protein, 433 aa, Homo sapiens
  Payload ID: 3353
  Gene Symbol: C6orf136
  Gene Name: chromosome 6 open reading frame 136
  ENSP ID: ENSP00000389259
LPTCALQRVDRLGVAGAGGRRCRACRARTSVLPGLRAVRRGQGQAAGRVCVAPDSPRLPVPRGDLKGRGREIRSPAAAPSRSSPAQTRPAGRPQQPARLALGERSWQEGRPVCTRFGPLRPGWQDGHAPSRDGASRTPSGTEDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 16738 - protein, 315 aa, Homo sapiens; identical to SEQ ID NO: 16733
  Payload ID: 3353
  Gene Symbol: C6orf136
  Gene Name: chromosome 6 open reading frame 136
  Uniprot ID: Q5SQH8
  ENSP ID: ENSP00000390275

SEQ ID NO: 16739 - protein, 181 aa, Homo sapiens; identical to SEQ ID NO: 16732
  Payload ID: 3353
  Gene Symbol: C6orf136
  Gene Name: chromosome 6 open reading frame 136
  Uniprot ID: Q5SQH8
  ENSP ID: ENSP00000391657

SEQ ID NO: 16740 - protein, 433 aa, Homo sapiens; identical to SEQ ID NO: 16737
  Payload ID: 3353
  Gene Symbol: C6orf136
  Gene Name: chromosome 6 open reading frame 136
  ENSP ID: ENSP00000393004

SEQ ID NO: 16741 - protein, 181 aa, Homo sapiens; identical to SEQ ID NO: 16732
  Payload ID: 3353
  Gene Symbol: C6orf136
  Gene Name: chromosome 6 open reading frame 136
  Uniprot ID: Q5SQH8
  ENSP ID: ENSP00000395979

SEQ ID NO: 16742 - protein, 315 aa, Homo sapiens; identical to SEQ ID NO: 16733
  Payload ID: 3353
  Gene Symbol: C6orf136
  Gene Name: chromosome 6 open reading frame 136
  Uniprot ID: Q5SQH8
  ENSP ID: ENSP00000396916

SEQ ID NO: 16743 - protein, 315 aa, Homo sapiens; identical to SEQ ID NO: 16733
  Payload ID: 3353
  Gene Symbol: C6orf136
  Gene Name: chromosome 6 open reading frame 136
  Uniprot ID: Q5SQH8
  ENSP ID: ENSP00000398769

SEQ ID NO: 16744 - protein, 181 aa, Homo sapiens; identical to SEQ ID NO: 16732
  Payload ID: 3353
  Gene Symbol: C6orf136
  Gene Name: chromosome 6 open reading frame 136
  Uniprot ID: Q5SQH8
  ENSP ID: ENSP00000402805

SEQ ID NO: 16745 - protein, 433 aa, Homo sapiens
  Payload ID: 3353
  Gene Symbol: C6orf136
  Gene Name: chromosome 6 open reading frame 136
  ENSP ID: ENSP00000403409
LPTCALQRVDRLGVAEAGGRRCRACRARTSVLPGLRAVRRGQGQAAGRVCVAPDSPRLPVPRGDLKGRGREIRSPAAAPSRSSPAQTRPAGRPQQPARLALGERSWQEGRPVCTRFGPLRPGWQDGHAPSRDGASRTPSGTEDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 16746 - protein, 433 aa, Homo sapiens; identical to SEQ ID NO: 16737
  Payload ID: 3353
  Gene Symbol: C6orf136
  Gene Name: chromosome 6 open reading frame 136
  ENSP ID: ENSP00000404560

SEQ ID NO: 16747 - protein, 315 aa, Homo sapiens; identical to SEQ ID NO: 16733
  Payload ID: 3353
  Gene Symbol: C6orf136
  Gene Name: chromosome 6 open reading frame 136
  Uniprot ID: Q5SQH8
  ENSP ID: ENSP00000404588

SEQ ID NO: 16748 - protein, 181 aa, Homo sapiens; identical to SEQ ID NO: 16732
  Payload ID: 3353
  Gene Symbol: C6orf136
  Gene Name: chromosome 6 open reading frame 136
  Uniprot ID: Q5SQH8
  ENSP ID: ENSP00000405594

SEQ ID NO: 16749 - protein, 433 aa, Homo sapiens; identical to SEQ ID NO: 16737
  Payload ID: 3353
  Gene Symbol: C6orf136
  Gene Name: chromosome 6 open reading frame 136
  ENSP ID: ENSP00000411113

SEQ ID NO: 16750 - protein, 433 aa, Homo sapiens; identical to SEQ ID NO: 16737
  Payload ID: 3353
  Gene Symbol: C6orf136
  Gene Name: chromosome 6 open reading frame 136
  ENSP ID: ENSP00000415028

SEQ ID NO: 16751 - protein, 433 aa, Homo sapiens; identical to SEQ ID NO: 16737
  Payload ID: 3353
  Gene Symbol: C6orf136
  Gene Name: chromosome 6 open reading frame 136
  ENSP ID: ENSP00000415810

SEQ ID NO: 16752 - protein, 315 aa, Homo sapiens; identical to SEQ ID NO: 16733
  Payload ID: 3353
  Gene Symbol: C6orf136
  Gene Name: chromosome 6 open reading frame 136
  Uniprot ID: Q5SQH8
  ENSP ID: ENSP00000415915

SEQ ID NO: 16753 - protein, 104 aa, Homo sapiens
  Payload ID: 3353
  Gene Symbol: C6orf136
  Gene Name: chromosome 6 open reading frame 136
  ENSP ID: ENSP00000418154
INEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKVSPR

SEQ ID NO: 16754 - protein, 58 aa, Homo sapiens
  Payload ID: 3353
  Gene Symbol: C6orf136
  Gene Name: chromosome 6 open reading frame 136
  ENSP ID: ENSP00000418223
MYQPSRGAARRLGPCLRAYQARPQGPDMVHSFTDPLPFPGLELFCTPSFGGFTADPPP

SEQ ID NO: 16755 - protein, 90 aa, Homo sapiens
  Payload ID: 3353
  Gene Symbol: C6orf136
  Gene Name: chromosome 6 open reading frame 136
  ENSP ID: ENSP00000418599
MYQPSRGAARRLGPCLRAYQARPQERGRRDQDLSCIAAAWMGLEAFLRDLPAPILGLGYLSKSLELPTLPLPPRQEILVWRNICLSCMRD

SEQ ID NO: 16756 - protein, 48 aa, Homo sapiens
  Payload ID: 3353
  Gene Symbol: C6orf136
  Gene Name: chromosome 6 open reading frame 136
  ENSP ID: ENSP00000418616
DPSMEEHLSVMYERLRQELPKLFLQSHDYSLYSLDVEFINEILNIRTK

SEQ ID NO: 16757 - protein, 28 aa, Homo sapiens
  Payload ID: 3353
  Gene Symbol: C6orf136
  Gene Name: chromosome 6 open reading frame 136
  ENSP ID: ENSP00000419460
QARWRLVGLPVHLLFLRFYKRDKDEHYR

SEQ ID NO: 16758 - protein, 95 aa, Homo sapiens
  Payload ID: 3353
  Gene Symbol: C6orf136
  Gene Name: chromosome 6 open reading frame 136
  ENSP ID: ENSP00000419610
  MOD_RES (1)..(1): Any amino acid
XGRTWYILSLTLCRFLAWNYFAHLRLEVLQLTRHPENWTLQARWRLVGLPVHLLFLRFYKRDKDEHYRTYDAYSTFYLNSSGLICRHRLDKVSPS

SEQ ID NO: 16759 - protein, 188 aa, Homo sapiens
  Payload ID: 3353
  Gene Symbol: C6orf136
  Gene Name: chromosome 6 open reading frame 136
  ENSP ID: ENSP00000419968
MYQPSRGAARRLGPCLRAYQARPQDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTK

SEQ ID NO: 16760 - protein, 244 aa, Homo sapiens
  Payload ID: 3354
  Gene Symbol: C6orf141
  Gene Name: chromosome 6 open reading frame 141
  Uniprot ID: Q5SZD1
  ENSP ID: ENSP00000431184
MNDPFARMETRGPQGAANPMDSSRSLGDLGPFPREVGRGAPLAPGARNPATAGASRSQGGGHEDRTADRALGPRAGEELDRESWVREKVLFLLHPERWLGTRGDPAREEVAGAEDLPHAGGEDHGEEPNYPSVFQRQKRISGRRVAPPRDAADPPKYVLVRVEDYQVTQEVLQTSWAKGRMTTRTEEHFVTALTFRSSREGQPGERWGPAESRALQARTGASRVHAAGRRVSPSPGTWLEEIKL

SEQ ID NO: 16761 - protein, 72 aa, Homo sapiens
  Payload ID: 3354
  Gene Symbol: C6orf141
  Gene Name: chromosome 6 open reading frame 141
  ENSP ID: ENSP00000434131
  MOD_RES (1)..(1): Any amino acid
XTSWAKGRMTTRTEEHFVTALTFRSSREGQPGERWGPAESRALQARTGASRVHAAGRRVSPSPGTWLEEIKL

SEQ ID NO: 16762 - protein, 244 aa, Homo sapiens; identical to SEQ ID NO: 16760
  Payload ID: 3354
  Gene Symbol: C6orf141
  Gene Name: chromosome 6 open reading frame 141
  Uniprot ID: Q5SZD1
  ENSP ID: ENSP00000434602

SEQ ID NO: 16763 - protein, 244 aa, Homo sapiens; identical to SEQ ID NO: 16760
  Payload ID: 3354
  Gene Symbol: C6orf141
  Gene Name: chromosome 6 open reading frame 141
  Uniprot ID: Q5SZD1
  ENSP ID: ENSP00000436754

SEQ ID NO: 16764 - protein, 325 aa, Homo sapiens
  Payload ID: 3355
  Gene Symbol: C6orf15
  Gene Name: chromosome 6 open reading frame 15
  Uniprot ID: Q6UXA7
  ENSP ID: ENSP00000259870
MQGRVAGSCAPLGLLLVCLHLPGLFARSIGVVEEKVSQNLGTNLPQLGQPSSTGPSNSEHPQPALDPRSNDLARVPLKLSVPASDGFPPAGGSAVQRWPPSWGLPAMDSWPPEDPWQMMAAAAEDRLGEALPEELSYLSSAAALAPGSGPLPGESSPDATGLSPKASLLHQDSESRRLPRSNSLGAGGKILSQRPPWSLIHRVLPDHPWGTLNPSVSWGGGGPGTGWGTRPMPHPEGIWGINNQPPGTSWGNINRYPGGSWGNINRYPGGSWGNINRYPGGSWGNIHLYPGINNPFPPGVLRPPGSSWNIPAGFPNPPSPRLQWG

SEQ ID NO: 16765 - protein, 325 aa, Homo sapiens
  Payload ID: 3355
  Gene Symbol: C6orf15
  Gene Name: chromosome 6 open reading frame 15
  Uniprot ID: Q6UXA7
  ENSP ID: ENSP00000373024
MQGRVAGSCAPLGLLLVCLHLPGLFARSIGVVEEKVSQNFGTDLPQLGQPSSTGPSNSEHPQPALDPRSNDLARVPLKLSVPPSDGFPPAGGSAVQRWPPSWGLPAMDSWPPEDPWQMMAAAAEDRLGEALPEELSYLSSAAALAPGSGPLPGESSPDATGLSPEASLLHQDSESRRLPRSNSLGAGGKILSQRPPWSLIHRVLPDHPWGTLNPSVSWGGGGPGTGWGTRPMPHPEGIWGINNQPPGTSWGNINRYPGGSWGNINRYPGGSWGNINRYPGGSWGNIHLYPGINNPFPPGVLRPPGSSWNIPAGFPNPPSPRLQWG

SEQ ID NO: 16766 - protein, 325 aa, Homo sapiens; identical to SEQ ID NO: 16764
  Payload ID: 3355
  Gene Symbol: C6orf15
  Gene Name: chromosome 6 open reading frame 15
  Uniprot ID: Q6UXA7
  ENSP ID: ENSP00000391756

SEQ ID NO: 16767 - protein, 325 aa, Homo sapiens; identical to SEQ ID NO: 16764
  Payload ID: 3355
  Gene Symbol: C6orf15
  Gene Name: chromosome 6 open reading frame 15
  Uniprot ID: Q6UXA7
  ENSP ID: ENSP00000394931

SEQ ID NO: 16768 - protein, 325 aa, Homo sapiens; identical to SEQ ID NO: 16764
  Payload ID: 3355
  Gene Symbol: C6orf15
  Gene Name: chromosome 6 open reading frame 15
  Uniprot ID: Q6UXA7
  ENSP ID: ENSP00000398496

SEQ ID NO: 16769 - protein, 325 aa, Homo sapiens [sequence omitted]

SEQ ID NO: 16770 - protein, 329 aa, Homo sapiens
  Payload ID: 3356
  Gene Symbol: C6orf163
  Gene Name: chromosome 6 open reading frame 163
  Uniprot ID: Q5TEZ5
  ENSP ID: ENSP00000373575
MIRNSDYKNFVCCAVCNKIIPPAPFGKTFKRIHEYKPLKTRFYTHKDILDIGANILKKEEQFQEDILREHIAKAEAEVWAQANERQKQAVEKALEEANDRHKIEIQILKEEHQKDLQEVTAKTKTEMYQNMDDEMKREHLAAEQRMVHRIQRIMMECHREKVEAVEKARAEERHIAQEAIQAQKSKAVEEIVNTGVTVIKDEKTSVARLMREKEHEMSILYGIAQRQRQEEVQEVLQEAEKTHQATLGNMMDKLANTQGELLSIAKQLGIMTNWKDFLEEELQETRMAFQKYINYTFPKLSPGHADFILPERKKTPSNLVIKENKTTLD

SEQ ID NO: 16771 - protein, 199 aa, Homo sapiens
  Payload ID: 3356
  Gene Symbol: C6orf163
  Gene Name: chromosome 6 open reading frame 163
  ENSP ID: ENSP00000477323
MDDEMKREHLAAEQRMVHRIQRIMMECHREKVEAVEKARAEERHIAQEAIQAQKSKAVEEIVNTGVTVIKDEKTSVARLMREKEHEMSILYGIAQRQRQEEVQEVLQEAEKTHQATLGNMMDKLANTQGELLSIAKQLGIMTNWKDFLEEELQETRMAFQKYINYTFPKLSPGHADFILPERKKTPSNLVIKENKTTLD

SEQ ID NO: 16772 - protein, 624 aa, Homo sapiens
  Payload ID: 3357
  Gene Symbol: C6orf183
  Gene Name: chromosome 6 open reading frame 183
  ENSP ID: ENSP00000475092
MDEIYKITSTERVQLLEKKLAVQLTELKSEIEEQGALQGTANRVYSSIQMPKDIYYFRRERELALKKTLQVAESKPLVVQADAVQRELESCLRREYTPENLPLLLLQYYTERIAQLAQSKYLHMLRWKRFCQHSKIMEQLYPLYKKQVGYIMQEYNDTLQRAERLSVARENFLMGKNNPPNLVTQEDLTIYTKWLVCHLHSLGTVHQYLQALQYLPISKVLSVAFNRVAEAGQKNENVCVNDIDPDIQGSASPDPVDTSISGPMRTEAAFVLPQHATETGELKPQLKLLLSHFSIPYDVEELWDSAKEMELFSLVSQKFQSVFMEQQRLQMFPDCEAGIAKADNLGLAGPRMTLKKKANWISFIKIKPKCDPWQKKLLTKLKERRRTDALLQLQAKFLKISNPEVMQVLQDHAAKTVMLAPHQPSFVASQGLHQGNYDQVWENIDNNINLCQNKNMKDDDLSMKQNENDLSQITLSQHADGPLKQIQETGYNYAMTLQLLGLEDGTDPSDRNPVLMRGAYLSFLYLCHLRIRELQHICLGILNYFRSVERTLTINTSGLTLVSGKLVPTMEDSSWVNMAKGGLGTLQGLGAHHYVRETPAEHKVHSVQFMEFSEVENQDDYYST

SEQ ID NO: 16773 - protein, 115 aa, Homo sapiens
  Payload ID: 3358
  Gene Symbol: C6orf201
  Gene Name: chromosome 6 open reading frame 201
  ENSP ID: ENSP00000417981
MLSNLHELLPNHLMETLYSRKSEEDKKKCENPELSGLERILARHQLPKEINLTPKPNRMPPWKRKIINNVTDGWKKCHLLKRNTKEPPMSTIVVSNTIPSILLPCYMAEKEHATH

SEQ ID NO: 16774 - protein, 131 aa, Homo sapiens
  Payload ID: 3358
  Gene Symbol: C6orf201
  Gene Name: chromosome 6 open reading frame 201
  Uniprot ID: Q7Z4U5
  ENSP ID: ENSP00000419568
MASGPLGPGARPTRLHPPFPPPAHIKPGAPPGENPELSGLERILARHQLPKEINLTPKPNRMPPWKRKIINNVTDGWKKCHLLKRNTKEPPMSTIVVRKLIQKNVPRRHSLRNTSRKLRNLPTTAKGTQTE

SEQ ID NO: 16775 - protein, 140 aa, Homo sapiens
  Payload ID: 3358
  Gene Symbol: C6orf201
  Gene Name: chromosome 6 open reading frame 201
  Uniprot ID: Q7Z4U5
  ENSP ID: ENSP00000420610
MLSNLHELLPNHLMETLYSRKSEEDKKKCENPELSGLERILARHQLPKEINLTPKPNRMPPWKRKIINNVTDGWKKCHLLKRNTKEPPMSTIVVRKLIQKNVPRRHSLRNTSRKLRNLPTTAKGTQTGKSQCLLGISEPT

SEQ ID NO: 16776 - protein, 138 aa, Homo sapiens
  Payload ID: 3358
  Gene Symbol: C6orf201
  Gene Name: chromosome 6 open reading frame 201
  ENSP ID: ENSP00000420763
MLSNLHELLPNHLMETLYSRKSEEDKKKCENPELSGLERILARHQLPKEINLTPKPNRMPPWKRKIINNVTDGWKKCHLLKRNTKEPPMSTIVVRKLIQKNVPRRHSLRNTSRKLRNLPTTAKGTQTVKSHETSRMNR

SEQ ID NO: 16777 - protein, 240 aa, Homo sapiens
  Payload ID: 3359
  Gene Symbol: C6orf203
  Gene Name: chromosome 6 open reading frame 203
  Uniprot ID: Q9P0P8
  ENSP ID: ENSP00000310951
MAMASVKLLAGVLRKPDAWIGLWGVLRGTPSSYKLCTSWNRYLYFSSTKLRAPNYKTLFYNIFSLRLPGLLLSPECIFPFSVRLKSNIRSTKSTKKSLQKVDEEDSDEESHHDEMSEQEEELEDDPTVVKNYKDLEKAVQSFRYDVVLKTGLDIGRNKVEDAFYKGELRLNEEKLWKKSRTVKVGDTLDLLIGEDKEAGTETVMRILLKKVFEEKTESEKYRVVLRRWKSLKLPKKRMSK

SEQ ID NO: 16778 - protein, 240 aa, Homo sapiens; identical to SEQ ID NO: 16777
  Payload ID: 3359
  Gene Symbol: C6orf203
  Gene Name: chromosome 6 open reading frame 203
  Uniprot ID: Q9P0P8
  ENSP ID: ENSP00000384867

SEQ ID NO: 16779 - protein, 245 aa, Homo sapiens
  Payload ID: 3359
  Gene Symbol: C6orf203
  Gene Name: chromosome 6 open reading frame 203
  ENSP ID: ENSP00000485698
MIISAMAMASVKLLAGVLRKPDAWIGLWGVLRGTPSSYKLCTSWNRYLYFSSTKLRAPNYKTLFYNIFSLRLPGLLLSPECIFPFSVRLKSNIRSTKSTKKSLQKVDEEDSDEESHHDEMSEQEEELEDDPTVVKNYKDLEKAVQSFRYDVVLKTGLDIGRNKVEDAFYKGELRLNEEKLWKKSRTVKVGDTLDLLIGEDKEAGTETVMRILLKKVFEEKTESEKYRVVLRRWKSLKLPKKRMSK

SEQ ID NO: 16780 - protein, 652 aa, Homo sapiens
  Payload ID: 3360
  Gene Symbol: C6orf222
  Gene Name: chromosome 6 open reading frame 222
  Uniprot ID: P0C671
  ENSP ID: ENSP00000418983
MENPRCPRRPLAEKKARSLDRPQAPGKGSESWDCHWLSLPTAPSRKALHWTTSDWARHSDSPAPSAEAHCTTAAAPTPEETGDFLPSEQRPSQDTKKGWLKTMLNFFVRTGPEEPREKASRRPRGKEGISQHPEPLEAAGEPALRKKAHHDKKPSRKKQGHKKHAAEVTKAAQDQEARGREEGLSKAAAALRSGEADLGPARRGGEDSDHQSFLIKVDGTGALDVSPHATGHQQEEELKKPDQDAIIQMIVELLKRVGDQWEEEQSLASQLGVALPNPAPAVRKKSQEKKTSLKRTSKTNPKKHGSEEAKRGAADVSSPEAWPPKKSSFLPLCVSGHRPSISSSYGLEEPKVQEAPSTEAGAPGPSVLPTPSESQEPGEELPLDRASEYKEFIQKIISMLQDAEEQQGEEQPQVQQEEVGVENPAPHCRRKSQEKRSSFRRAFYHKKHTSKEPRRAGAAGAASPEARRPKRPSFLPLCVGGHRPSTSSSLDPEDLECREPLPAEGEPVVISEAPSQARGHTPEGAPQLSGACESKEIIIQKLVALLQEVDGQLGQQIRRHPSFKRFFYEFSDSSLSKLVATLRSQVAHSSKLDRNRARRLYQFDVSLANKFAGSNSHAMCILMGLRDHYNCTQFPYREDQPNITSPKVESPD

SEQ ID NO: 16781 - protein, 105 aa, Homo sapiens
  Payload ID: 3361
  Gene Symbol: C6orf223
  Gene Name: chromosome 6 open reading frame 223
  Uniprot ID: Q8N319
  ENSP ID: ENSP00000423262
MMPLAEAGALAQGGGPSATEWACILRRLLRKEGVDGGLFSPEDPQAQAAHLTDGQSIQKKWQDFSCPQSRKTECFWQKEQHKQRSGNPRCLQFEGGERTPPPPQT

SEQ ID NO: 16782 - protein, 242 aa, Homo sapiens
  Payload ID: 3361
  Gene Symbol: C6orf223
  Gene Name: chromosome 6 open reading frame 223
  Uniprot ID: Q8N319
  ENSP ID: ENSP00000426159
MMPLAEAGALAQGGGPSATEWACILRRKTPRHKQPTLLMVRASRRSGKTSAVLKAGRQSVSGRKNSTSKDLVTLGASSLREERGHPLHPRHRKAVHLRTRGRTRGWVQTLARMSRRTRGPVERAAAAAAAAAGGDAGHAPFPPPPAADGARAPRSPGQVTPRGLRLRLPRRESLLRGLCRPLRPLLGFRESDSAKPASLRLLQHTPSARRNYRIAGARLMRSNYPPPLSSAALRGAGPTRRN

SEQ ID NO: 16783 - protein, 222 aa, Homo sapiens
  Payload ID: 3361
  Gene Symbol: C6orf223
  Gene Name: chromosome 6 open reading frame 223
  ENSP ID: ENSP00000477091
MEGSFHQKTPRHKQPTLLMVRASRRSGKTSAVLKAGRQSVSGRKNSTSKDLVTLGASSLREERGHPLHPRHRKAVHLRTRGRTRGWVQTLARMSRRTRGPVERAAAAAAAAAGGDAGHAPFPPPPAADGARAPRSPGQVTPRGLRLRLPRRESLLRGLCRPLRPLLGFRESDSAKPASLRLLQHTPSARRNYRIAGARLMRSNYPPPLSSAALRGAGPTRRN

SEQ ID NO: 16784 - protein, 101 aa, Homo sapiens
  Payload ID: 3362
  Gene Symbol: C6orf226
  Gene Name: chromosome 6 open reading frame 226
  Uniprot ID: Q5I0X4
  ENSP ID: ENSP00000386146
MERPRSPQCSAPASASASVTLAQLLQLVQQGQELPGLEKRHIAAIHGEPTASRLPRRPKPWEAAALAESLPPPTLRIGTAPAEPGLVEAATAPSSWHTVGP

SEQ ID NO: 16785 - protein, 230 aa, Homo sapiens
  Payload ID: 3363
  Gene Symbol: C6orf229
  Gene Name: chromosome 6 open reading frame 229
  Uniprot ID: H3BNL8
  ENSP ID: ENSP00000454913
MANSRFSCTQIWVKMYGYFAGLCRRLQKFWRVTVKGFFVKKKEKKIPSAETYFHEEKIVVLGQVLMNESLPIEKRAQAAQKIGLLAFTGGPPAGNFAAEYMEEVAHLLQDEELAPKIKILLLQSVACWCYLNPVSQKRAKSLQFIPILISFFEGRFESTIKSETNSYLLLKFWTCYVLSVMTCNNLSCVKELKDHSALKYHLQMLAAENWSGWTENFAEVLYFLIGFHRN

SEQ ID NO: 16786 - protein, 193 aa, Homo sapiens
  Payload ID: 3364
  Gene Symbol: C6orf25
  Gene Name: chromosome 6 open reading frame 25
  Uniprot ID: O95866
  ENSP ID: ENSP00000364962
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHALSPPHSSTCENRAPEASKGGRAQDSRGPGPGTEPALCGSGPSSPQQAPPAVHSGPC

SEQ ID NO: 16787 - protein, 217 aa, Homo sapiens
  Payload ID: 3364
  Gene Symbol: C6orf25
  Gene Name: chromosome 6 open reading frame 25
  Uniprot ID: O95866
  ENSP ID: ENSP00000364963
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGACPRNRFDHSLDLLCPPHIAPLVKTEPQRPVKEEEPKIPGDLDQEPSLLYADLDHLALSRPRRLSTADPADASTIYAVVV

SEQ ID NO: 16788 - protein, 241 aa, Homo sapiens
  Payload ID: 3364
  Gene Symbol: C6orf25
  Gene Name: chromosome 6 open reading frame 25
  Uniprot ID: O95866
  ENSP ID: ENSP00000364964
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFAPLVKTEPQRPVKEEEPKIPGDLDQEPSLLYADLDHLALSRPRRLSTADPADASTIYAVVV

SEQ ID NO: 16789 - protein, 237 aa, Homo sapiens
  Payload ID: 3364
  Gene Symbol: C6orf25
  Gene Name: chromosome 6 open reading frame 25
  Uniprot ID: O95866
  ENSP ID: ENSP00000364967
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFALSPPHSSTCENRAPEASKGGRAQDSRGPGPGTEPALCGSGPSSPQQAPPAVHSGPC

SEQ ID NO: 16790 - protein, 222 aa, Homo sapiens
  Payload ID: 3364
  Gene Symbol: C6orf25
  Gene Name: chromosome 6 open reading frame 25
  Uniprot ID: O95866
  ENSP ID: ENSP00000364968
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFALSPPHSSTCENRAPEASKGGRAQDSRGPGPGTGKGMGMGRG

SEQ ID NO: 16791 - protein, 197 aa, Homo sapiens
  Payload ID: 3364
  Gene Symbol: C6orf25
  Gene Name: chromosome 6 open reading frame 25
  Uniprot ID: O95866
  ENSP ID: ENSP00000364972
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHAPLVKTEPQRPVKEEEPKIPGDLDQEPSLLYADLDHLALSRPRRLSTADPADASTIYAVVV

SEQ ID NO: 16792 - protein, 197 aa, Homo sapiens; identical to SEQ ID NO: 16791
  Payload ID: 3364
  Gene Symbol: C6orf25
  Gene Name: chromosome 6 open reading frame 25
  Uniprot ID: O95866
  ENSP ID: ENSP00000372902

SEQ ID NO: 16793 - protein, 217 aa, Homo sapiens; identical to SEQ ID NO: 16787
  Payload ID: 3364
  Gene Symbol: C6orf25
  Gene Name: chromosome 6 open reading frame 25
  Uniprot ID: O95866
  ENSP ID: ENSP00000372903

SEQ ID NO: 16794 - protein, 237 aa, Homo sapiens; identical to SEQ ID NO: 16789
  Payload ID: 3364
  Gene Symbol: C6orf25
  Gene Name: chromosome 6 open reading frame 25
  Uniprot ID: O95866
  ENSP ID: ENSP00000372904

SEQ ID NO: 16795 - protein, 193 aa, Homo sapiens; identical to SEQ ID NO: 16786
  Payload ID: 3364
  Gene Symbol: C6orf25
  Gene Name: chromosome 6 open reading frame 25
  Uniprot ID: O95866
  ENSP ID: ENSP00000382940

SEQ ID NO: 16796 - protein, 241 aa, Homo sapiens; identical to SEQ ID NO: 16788
  Payload ID: 3364
  Gene Symbol: C6orf25
  Gene Name: chromosome 6 open reading frame 25
  Uniprot ID: O95866
  ENSP ID: ENSP00000382944

SEQ ID NO: 16797 - protein, 197 aa, Homo sapiens; identical to SEQ ID NO: 16791
  Payload ID: 3364
  Gene Symbol: C6orf25
  Gene Name: chromosome 6 open reading frame 25
  Uniprot ID: O95866
  ENSP ID: ENSP00000388484

SEQ ID NO: 16798 - protein, 193 aa, Homo sapiens; identical to SEQ ID NO: 16786
  Payload ID: 3364
  Gene Symbol: C6orf25
  Gene Name: chromosome 6 open reading frame 25
  Uniprot ID: O95866
  ENSP ID: ENSP00000388982

SEQ ID NO: 16799 - protein, 237 aa, Homo sapiens; identical to SEQ ID NO: 16789
  Payload ID: 3364
  Gene Symbol: C6orf25
  Gene Name: chromosome 6 open reading frame 25
  Uniprot ID: O95866
  ENSP ID: ENSP00000390272

SEQ ID NO: 16800 - protein, 197 aa, Homo sapiens; identical to SEQ ID NO: 16791
  Payload ID: 3364
  Gene Symbol: C6orf25
  Gene Name: chromosome 6 open reading frame 25
  Uniprot ID: O95866
  ENSP ID: ENSP00000390821

SEQ ID NO: 16801 - protein, 241 aa, Homo sapiens; identical to SEQ ID NO: 16788
  Payload ID: 3364
  Gene Symbol: C6orf25
  Gene Name: chromosome 6 open reading frame 25
  Uniprot ID: O95866
  ENSP ID: ENSP00000391097

SEQ ID NO: 16802 - protein, 193 aa, Homo sapiens; identical to SEQ ID NO: 16786
  Payload ID: 3364
  Gene Symbol: C6orf25
  Gene Name: chromosome 6 open reading frame 25
  Uniprot ID: O95866
  ENSP ID: ENSP00000392917

SEQ ID NO: 16803 - protein, 193 aa, Homo sapiens; identical to SEQ ID NO: 16786
  Payload ID: 3364
  Gene Symbol: C6orf25
  Gene Name: chromosome 6 open reading frame 25
  Uniprot ID: O95866
  ENSP ID: ENSP00000392961

SEQ ID NO: 16804 - protein, 197 aa, Homo sapiens; identical to SEQ ID NO: 16791
  Payload ID: 3364
  Gene Symbol: C6orf25
  Gene Name: chromosome 6 open reading frame 25
  Uniprot ID: O95866
  ENSP ID: ENSP00000394082

SEQ ID NO: 16805 - protein, 217 aa, Homo sapiens; identical to SEQ ID NO: 16787
  Payload ID: 3364
  Gene Symbol: C6orf25
  Gene Name: chromosome 6 open reading frame 25
  Uniprot ID: O95866
  ENSP ID: ENSP00000395279

SEQ ID NO: 16806 - protein, 237 aa, Homo sapiens; identical to SEQ ID NO: 16789
  Payload ID: 3364
  Gene Symbol: C6orf25
  Gene Name: chromosome 6 open reading frame 25
  Uniprot ID: O95866
  ENSP ID: ENSP00000395801

SEQ ID NO: 16807 - protein, 217 aa, Homo sapiens; identical to SEQ ID NO: 16787
  Payload ID: 3364
  Gene Symbol: C6orf25
  Gene Name: chromosome 6 open reading frame 25
  Uniprot ID: O95866
  ENSP ID: ENSP00000396823

SEQ ID NO: 16808 - protein, 217 aa, Homo sapiens; identical to SEQ ID NO: 16787
  Payload ID: 3364
  Gene Symbol: C6orf25
  Gene Name: chromosome 6 open reading frame 25
  Uniprot ID: O95866
  ENSP ID: ENSP00000398061

SEQ ID NO: 16809 - protein, 217 aa, Homo sapiens; identical to SEQ ID NO: 16787
  Payload ID: 3364
  Gene Symbol: C6orf25
  Gene Name: chromosome 6 open reading frame 25
  Uniprot ID: O95866
  ENSP ID: ENSP00000401892

SEQ ID NO: 16810 - protein, 237 aa, Homo sapiens; identical to SEQ ID NO: 16789
  Payload ID: 3364
  Gene Symbol: C6orf25
  Gene Name: chromosome 6 open reading frame 25
  Uniprot ID: O95866
  ENSP ID: ENSP00000404519

SEQ ID NO: 16811 - protein, 241 aa, Homo sapiens; identical to SEQ ID NO: 16788
  Payload ID: 3364
  Gene Symbol: C6orf25
  Gene Name: chromosome 6 open reading frame 25
  Uniprot ID: O95866
  ENSP ID: ENSP00000406706

SEQ ID NO: 16812 - protein, 241 aa, Homo sapiens
  Payload ID: 3364
  Gene Symbol: C6orf25
  Gene Name: chromosome 6 open reading frame 25
  ENSP ID: ENSP00000407677
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIGPLPRFAPLVKTEPQRPVKEEEPKIPGDLDQEPSLLYADLDHLALSRPRRLSTADPADASTIYAVVV

SEQ ID NO: 16813 - protein, 237 aa, Homo sapiens
  Payload ID: 3364
  Gene Symbol: C6orf25
  Gene Name: chromosome 6 open reading frame 25
  ENSP ID: ENSP00000407683
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIGPLPRFALSPPHSSTCENRAPEASKGGRAQDSRGPGPGTEPALCGSGPSSPQQAPPAVHSGPC

SEQ ID NO: 16814 - protein, 241 aa, Homo sapiens; identical to SEQ ID NO: 16788
  Payload ID: 3364
  Gene Symbol: C6orf25
  Gene Name: chromosome 6 open reading frame 25
  Uniprot ID: O95866
  ENSP ID: ENSP00000408430

SEQ ID NO: 16815 - protein, 193 aa, Homo sapiens; identical to SEQ ID NO: 16786
  Payload ID: 3364
  Gene Symbol: C6orf25
  Gene Name: chromosome 6 open reading frame 25
  Uniprot ID: O95866
  ENSP ID: ENSP00000412747

SEQ ID NO: 16816 - protein, 193 aa, Homo sapiens; identical to SEQ ID NO: 16786
  Payload ID: 3364
  Gene Symbol: C6orf25
  Gene Name: chromosome 6 open reading frame 25
  Uniprot ID: O95866
  ENSP ID: ENSP00000412937

SEQ ID NO: 16817 - protein, 197 aa, Homo sapiens; identical to SEQ ID NO: 16791
  Payload ID: 3364
  Gene Symbol: C6orf25
  Gene Name: chromosome 6 open reading frame 25
  Uniprot ID: O95866
  ENSP ID: ENSP00000413647

SEQ ID NO: 16818 - protein, 217 aa, Homo sapiens
  Payload ID: 3364
  Gene Symbol: C6orf25
  Gene Name: chromosome 6 open reading frame 25
  ENSP ID: ENSP00000414621
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGACPRNRLDHSLDLLCPPHIAPLVKTEPQRPVKEEEPKIPGDLDQEPSLLYADLDHLALSRPRRLSTADPADASTIYAVVV

SEQ ID NO: 16819 - protein, 197 aa, Homo sapiens; identical to SEQ ID NO: 16791
  Payload ID: 3364
  Gene Symbol: C6orf25
  Gene Name: chromosome 6 open reading frame 25
  Uniprot ID: O95866
  ENSP ID: ENSP00000414824

SEQ ID NO: 16820 - protein, 237 aa, Homo sapiens; identical to SEQ ID NO: 16789
  Payload ID: 3364
  Gene Symbol: C6orf25
  Gene Name: chromosome 6 open reading frame 25
  Uniprot ID: O95866
  ENSP ID: ENSP00000415282

SEQ ID NO: 16821 - protein, 241 aa, Homo sapiens; identical to SEQ ID NO: 16788
  Payload ID: 3364
  Gene Symbol: C6orf25
  Gene Name: chromosome 6 open reading frame 25
  Uniprot ID: O95866
  ENSP ID: ENSP00000416447

SEQ ID NO: 16822 - protein, 220 aa, Homo sapiens
  Payload ID: 3364
  Gene Symbol: C6orf25
  Gene Name: chromosome 6 open reading frame 25
  ENSP ID: ENSP00000419306
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFAPLVKTEPQRPVKEEEPKIPGDLDQEPVRAWGWEGDSQNL

SEQ ID NO: 16823 - protein, 125 aa, Homo sapiens
  Payload ID: 3364
  Gene Symbol: C6orf25
  Gene Name: chromosome 6 open reading frame 25
  ENSP ID: ENSP00000420355
MAVFLQLLPLLLSRAQGNPGASLDGRPGDRVNLSCGGVSHPIRWVWAPSFPACKGLSKGRRPILWASSSGTPTVPPLQPFVGRLRSLDSAPDPAAGRWVGARTGSFGPGLVAAQAPAPATDSTTP

SEQ ID NO: 16824 - protein, 294 aa, Homo sapiens
  Payload ID: 3365
  Gene Symbol: C6orf47
  Gene Name: chromosome 6 open reading frame 47
  Uniprot ID: O95873
  ENSP ID: ENSP00000365076
MFLRRLGGWLPRPWGRRKPMRPDPPYPEPRRVDSSSENSGSDWDSAPETMEDVGHPKTKDSGALRVSGAASEPSKEEPQVEQLGSKRMDSLKWDQPISSTQESGRLEAGGASPKLRWDHVDSGGTRRPGVSPEGGLSVPGPGAPLEKPGRREKLLGWLRGEPGAPSRYLGGPEECLQISTNLTLHLLELLASALLALCSRPLRAALDTLGLRGPLGLWLHGLLSFLAALHGLHAVLSLLTAHPLHFACLFGLLQALVLAVSLREPNGDEAATDWESEGLEREGEEQRGDPGKGL

SEQ ID NO: 16825 - protein, 294 aa, Homo sapiens
  Payload ID: 3365
  Gene Symbol: C6orf47
  Gene Name: chromosome 6 open reading frame 47
  Uniprot ID: O95873
  ENSP ID: ENSP00000375392
MFLRRLGGWLPRPWGRRKPMRPDPPYPEPRRVDSSSENSGSDWDSAPETMEDVGHPKTKDSGALRVSRAASEPSKEEPQVEQLGSKRMDSLKWDQPISSTQESGRLEAGGASPKLRWDHVDSGGTRRPGVSPEGGLSVPGPGAPLEKPGRREKLLGWLRGEPGAPSRYLGGPEECLQISTNLTLHLLELLASALLALCSRPLRAALDTLGLRGPLGLWLHGLLSFLAALHGLHAVLSLLTAHPLHFACLFGLLQALVLAVSLREPNGDEAATDWESEGLEREGEEQRGDPGKGL

SEQ ID NO: 16826 - protein, 294 aa, Homo sapiens; identical to SEQ ID NO: 16825
  Payload ID: 3365
  Gene Symbol: C6orf47
  Gene Name: chromosome 6 open reading frame 47
  Uniprot ID: O95873
  ENSP ID: ENSP00000375400

SEQ ID NO: 16827 - protein, 294 aa, Homo sapiens; identical to SEQ ID NO: 16825
  Payload ID: 3365
  Gene Symbol: C6orf47
  Gene Name: chromosome 6 open reading frame 47
  Uniprot ID: O95873
  ENSP ID: ENSP00000395128

SEQ ID NO: 16828 - protein, 294 aa, Homo sapiens; identical to SEQ ID NO: 16825
  Payload ID: 3365
  Gene Symbol: C6orf47
  Gene Name: chromosome 6 open reading frame 47
  Uniprot ID: O95873
  ENSP ID: ENSP00000398221

SEQ ID NO: 16829 - protein, 294 aa, Homo sapiens; identical to SEQ ID NO: 16825
  Payload ID: 3365
  Gene Symbol: C6orf47
  Gene Name: chromosome 6 open reading frame 47
  Uniprot ID: O95873
  ENSP ID: ENSP00000406870

SEQ ID NO: 16830 - protein, 294 aa, Homo sapiens; identical to SEQ ID NO: 16824
  Payload ID: 3365
  Gene Symbol: C6orf47
  Gene Name: chromosome 6 open reading frame 47
  Uniprot ID: O95873
  ENSP ID: ENSP00000407188

SEQ ID NO: 16831 - protein, 75 aa, Homo sapiens
  Payload ID: 3366
  Gene Symbol: C6orf48
  Gene Name: chromosome 6 open reading frame 48
  Uniprot ID: Q9UBA6
  ENSP ID: ENSP00000364784
MERSFVWLSCLDSDSCNLTFRLGEVESHACSPSLLWNLLTQYLPPGAGHILRTYNFPVLSCVSSCHLIGGKMPEN

SEQ ID NO: 16832 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000364786

SEQ ID NO: 16833 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000364789

SEQ ID NO: 16834 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000364790

SEQ ID NO: 16835 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000364791

SEQ ID NO: 16836 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000364792

SEQ ID NO: 16837 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000364793

SEQ ID NO: 16838 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000372874

SEQ ID NO: 16839 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000372875

SEQ ID NO: 16840 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000372876

SEQ ID NO: 16841 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000379134

SEQ ID NO: 16842 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000379135

SEQ ID NO: 16843 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000382909

SEQ ID NO: 16844 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000382910

SEQ ID NO: 16845 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000382912

SEQ ID NO: 16846 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000382913

SEQ ID NO: 16847 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000382914

SEQ ID NO: 16848 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000387656

SEQ ID NO: 16849 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000387952

SEQ ID NO: 16850 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000388587

SEQ ID NO: 16851 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000388964

SEQ ID NO: 16852 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000389848

SEQ ID NO: 16853 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000390420

SEQ ID NO: 16854 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000392591

SEQ ID NO: 16855 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000392621

SEQ ID NO: 16856 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000392656

SEQ ID NO: 16857 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000394438

SEQ ID NO: 16858 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000394750

SEQ ID NO: 16859 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000395192

SEQ ID NO: 16860 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000395285

SEQ ID NO: 16861 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000396517

SEQ ID NO: 16862 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000397287

SEQ ID NO: 16863 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000397345

SEQ ID NO: 16864 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000397392

SEQ ID NO: 16865 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000397730

SEQ ID NO: 16866 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000401394

SEQ ID NO: 16867 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000402138

SEQ ID NO: 16868 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000405501

SEQ ID NO: 16869 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000405706

SEQ ID NO: 16870 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000406099

SEQ ID NO: 16871 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000408280

SEQ ID NO: 16872 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000408391

SEQ ID NO: 16873 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000414926

SEQ ID NO: 16874 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000415206

SEQ ID NO: 16875 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000417013

SEQ ID NO: 16876 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000448031

SEQ ID NO: 16877 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000448996

SEQ ID NO: 16878 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000449901

SEQ ID NO: 16879 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000449921

SEQ ID NO: 16880 - protein, 75 aa, Homo sapiens; identical to SEQ ID NO: 16831
  Payload ID: 3366
  Gene Symbol: C6orf48
  Gene Name: chromosome 6 open reading frame 48
  Uniprot ID: Q9UBA6
  ENSP ID: ENSP00000480389

SEQ ID NO: 16881 - protein, 152 aa, Homo sapiens
  Payload ID: 3367
  Gene Symbol: C6orf52
  Gene Name: chromosome 6 open reading frame 52
  Uniprot ID: Q5T4I8
  ENSP ID: ENSP00000259983
MAQPESSADFGIAQQNNYYCYWQSLPSAIRVKQEFQPSQSYRYGNWYARQHGSYLLSGYSYGCAVDGNGKDCFSAHETPEHTAGTLVMPKETTPLAENQDEDPLEDPHLHLNIEESNQEFMVKSEELYDSLMNCHWQPLDTVHSEIPDETPK

SEQ ID NO: 16882 - protein, 65 aa, Homo sapiens
  Payload ID: 3367
  Gene Symbol: C6orf52
  Gene Name: chromosome 6 open reading frame 52
  Uniprot ID: Q5T4I8
  ENSP ID: ENSP00000368905
MPKETTPLAENQDEDPLEDPHLHLNIEESNQEFMVKSEELYDSLMNCHWQPLDTVHSEIPDETPK

SEQ ID NO: 16883 - protein, 152 aa, Homo sapiens; identical to SEQ ID NO: 16881
  Payload ID: 3367
  Gene Symbol: C6orf52
  Gene Name: chromosome 6 open reading frame 52
  Uniprot ID: Q5T4I8
  ENSP ID: ENSP00000410749

SEQ ID NO: 16884 - protein, 63 aa, Homo sapiens
  Payload ID: 3367
  Gene Symbol: C6orf52
  Gene Name: chromosome 6 open reading frame 52
  ENSP ID: ENSP00000421264
METTPLAENQDEDPLEDPHLHLNIEESNQEFMVKSEELYDSLMNCHWQPLDTVHSEIPDETPK

SEQ ID NO: 16885 - protein, 93 aa, Homo sapiens
  Payload ID: 3367
  Gene Symbol: C6orf52
  Gene Name: chromosome 6 open reading frame 52
  ENSP ID: ENSP00000421837
METTPLAENQDEDPLEVTSQYVAQADLKLPDLSNSLVSASQSVGVTDPHLHLNIEESNQEFMVKSEELYDSLMNCHWQPLDTVHSEIPDETPK

SEQ ID NO: 16886 - protein, 330 aa, Homo sapiens
  Payload ID: 3368
  Gene Symbol: C6orf58
  Gene Name: chromosome 6 open reading frame 58
  Uniprot ID: Q6P5S2
  ENSP ID: ENSP00000328069
MAFLPSWVCVLVGSFSASLAGTSNLSETEPPLWKESPGQLSDYRVENSMYIINPWVYLERMGMYKIILNQTARYFAKFAPDNEQNILWGLPLQYGWQYRTGRLADPTRRTNCGYESGDHMCISVDSWWADLNYFLSSLPFLAAVDSGVMGISSDQVRLLPPPKNERKFCYDVSSCRSSFPETMNKWNTFYQYLQSPFSKFDDLLKYLWAAHTSTLADNIKSFEDRYDYYSKAEAHFERSWVLAVDHLAAVLFPTTLIRSYKFQKGMPPRILLNTDVAPFISDFTAFQNVVLVLLNMLDNVDKSIGYLCTEKSNVYRDHSESSSRSYGNNS

SEQ ID NO: 16887 - protein, 200 aa, Homo sapiens
  Payload ID: 3369
  Gene Symbol: C6orf62
  Gene Name: chromosome 6 open reading frame 62
  Uniprot ID: Q9GZU0
  ENSP ID: ENSP00000367342
MSENLSDPVSPVVRKKKSALFEVSEVIPVMTNNYEENILKGVRDSSYSLESSLELLQKDVVQLHAPRYQSMRRDVIGCTQEMDFILWPRNDIEKIVCLLFSRWKESDEPFRPVQAKFEFHHGDYEKQFLHVLSRKDKTGIVVNNPNQSVFLFIDRQHLQTPKNKATIFKLCSICLYLPQEQLTHWAVGTIEDHLRPYMPE

SEQ ID NO: 16888 - protein, 229 aa, Homo sapiens
  Payload ID: 3369
  Gene Symbol: C6orf62
  Gene Name: chromosome 6 open reading frame 62
  Uniprot ID: Q9GZU0
  ENSP ID: ENSP00000367359
MGDPNSRKKQALNRLRAQLRKKKESLADQFDFKMYIAFVFKEKKKKSALFEVSEVIPVMTNNYEENILKGVRDSSYSLESSLELLQKDVVQLHAPRYQSMRRDVIGCTQEMDFILWPRNDIEKIVCLLFSRWKESDEPFRPVQAKFEFHHGDYEKQFLHVLSRKDKTGIVVNNPNQSVFLFIDRQHLQTPKNKATIFKLCSICLYLPQEQLTHWAVGTIEDHLRPYMPE

SEQ ID NO: 16889 - protein, 354 aa, Homo sapiens
  Payload ID: 3370
  Gene Symbol: C6orf89
  Gene Name: chromosome 6 open reading frame 89
  Uniprot ID: Q6UWU4
  ENSP ID: ENSP00000347322
MDFILEDMDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 16890 - protein, 241 aa, Homo sapiens
  Payload ID: 3370
  Gene Symbol: C6orf89
  Gene Name: chromosome 6 open reading frame 89
  ENSP ID: ENSP00000352316
MSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 16891 - protein, 347 aa, Homo sapiens
  Payload ID: 3370
  Gene Symbol: C6orf89
  Gene Name: chromosome 6 open reading frame 89
  Uniprot ID: Q6UWU4
  ENSP ID: ENSP00000362789
MDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 16892 - protein, 347 aa, Homo sapiens; identical to SEQ ID NO: 16891
  Payload ID: 3370
  Gene Symbol: C6orf89
  Gene Name: chromosome 6 open reading frame 89
  Uniprot ID: Q6UWU4
  ENSP ID: ENSP00000475947

SEQ ID NO: 16893 - protein, 421 aa, Homo sapiens
  Payload ID: 3371
  Gene Symbol: C7orf25
  Gene Name: chromosome 7 open reading frame 25
  Uniprot ID: Q9BPX7
  ENSP ID: ENSP00000343364
MSAHSMLCERIAIAKELIKRAESLSRSRKGGIEGGAKLCSKLKAELKFLQKVEAGKVAIKESHLQSTNLTHLRAIVESAENLEEVVSVLHVFGYTDTLGEKQTLVVDVVANGGHTWVKAIGRKAEALHNIWLGRGQYGDKSIIEQAEDFLQASHQQPVQYSNPHIIFAFYNSVSSPMAEKLKEMGISVRGDIVAVNALLDHPEELQPSESESDDEGPELLQVTRVDRENILASVAFPTEIKVDVCKRVNLDITTLITYVSALSYGGCHFIFKEKVLTEQAEQERKEQVLPQLEAFMKDKELFACESAVKDFQSILDTLGGPGERERATVLIKRINVVPDQPSERALRLVASSKINSRSLTIFGTGDTLKAITMTANSGFVRAANNQGVKFSVFIHQPRALTESKEALATPLPKDYTTDSEH

SEQ ID NO: 16894 - protein, 421 aa, Homo sapiens; identical to SEQ ID NO: 16893
  Payload ID: 3371
  Gene Symbol: C7orf25
  Gene Name: chromosome 7 open reading frame 25
  Uniprot ID: Q9BPX7
  ENSP ID: ENSP00000396597

SEQ ID NO: 16895 - protein, 479 aa, Homo sapiens
  Payload ID: 3371
  Gene Symbol: C7orf25
  Gene Name: chromosome 7 open reading frame 25
  Uniprot ID: Q9BPX7
  ENSP ID: ENSP00000413029
MQEVPEAAGLARVEPPRRSSGVGAARLRFPGGSRPLRARACVLALAVLALPERNNADSMSAHSMLCERIAIAKELIKRAESLSRSRKGGIEGGAKLCSKLKAELKFLQKVEAGKVAIKESHLQSTNLTHLRAIVESAENLEEVVSVLHVFGYTDTLGEKQTLVVDVVANGGHTWVKAIGRKAEALHNIWLGRGQYGDKSIIEQAEDFLQASHQQPVQYSNPHIIFAFYNSVSSPMAEKLKEMGISVRGDIVAVNALLDHPEELQPSESESDDEGPELLQVTRVDRENILASVAFPTEIKVDVCKRVNLDITTLITYVSALSYGGCHFIFKEKVLTEQAEQERKEQVLPQLEAFMKDKELFACESAVKDFQSILDTLGGPGERERATVLIKRINVVPDQPSERALRLVASSKINSRSLTIFGTGDTLKAITMTANSGFVRAANNQGVKFSVFIHQPRALTESKEALATPLPKDYTTDSEH

SEQ ID NO: 16896 - protein, 178 aa, Homo sapiens
  Payload ID: 3371
  Gene Symbol: C7orf25
  Gene Name: chromosome 7 open reading frame 25
  ENSP ID: ENSP00000413106
MSAHSMLCERIAIAKELIKRAESLSRSRKGGIEGGAKLCSKLKAELKFLQKVEAGKVAIKESHLQSTNLTHLRAIVESAENLEEVVSVLHVFGYTDTLGEKQTLVVDVVANGGHTWVKAIGRKAEALHNIWLGRGQYGDKSIIEQAEDFLQASHQQPVQYSNPHIIFAFYNSVSSPMA

SEQ ID NO: 16897 - protein, 479 aa, Homo sapiens; identical to SEQ ID NO: 16895
  Payload ID: 3371
  Gene Symbol: C7orf25
  Gene Name: chromosome 7 open reading frame 25
  Uniprot ID: Q9BPX7
  ENSP ID: ENSP00000416290

SEQ ID NO: 16898 - protein, 85 aa, Homo sapiens
  Payload ID: 3371
  Gene Symbol: C7orf25
  Gene Name: chromosome 7 open reading frame 25
  ENSP ID: ENSP00000416542
MSAHSMLCERIAIAKELIKRAESLSRSRKGGIEGGAKLCSKLKAELKFLQKVEAGKVAIKESHLQSTNLTHLRAIVESAENLEEV

SEQ ID NO: 16899 - protein, 449 aa, Homo sapiens
  Payload ID: 3372
  Gene Symbol: C7orf26
  Gene Name: chromosome 7 open reading frame 26
  Uniprot ID: Q96N11
  ENSP ID: ENSP00000340220
MSDIRHSLLRRDALSAAKEVLYHLDIYFSSQLQSAPLPIVDKGPVELLEEFVFQVPKERSAQPKRLNSLQELQLLEIMCNYFQEQTKDSVRQIIFSSLFSPQGNKADDSRMSLLGKLVSMAVAVCRIPVLECAASWLQRTPVVYCVRLAKALVDDYCCLVPGSIQTLKQIFSASPRFCCQFITSVTALYDLSSDDLIPPMDLLEMIVTWIFEDPRLILITFLNTPIAANLPIGFLELTPLVGLIRWCVKAPLAYKRKKKPPLSNGHVSNKVTKDPGVGMDRDSHLLYSKLHLSVLQVLMTLQLHLTEKNLYGRLGLILFDHMVPLVEEINRLADELNPLNASQEIELSLDRLAQALQVAMASGALLCTRDDLRTLCSRLPHNNLLQLVISGPVQQSPHAALPPGFYPHIHTPPLGYGAVPAHPAAHPALPTHPGHTFISGVTFPFRPIR

SEQ ID NO: 16900 - protein, 352 aa, Homo sapiens
  Payload ID: 3372
  Gene Symbol: C7orf26
  Gene Name: chromosome 7 open reading frame 26
  Uniprot ID: Q96N11
  ENSP ID: ENSP00000351974
MSDIRHSLLRRDALSAAKEVLYHLDIYFSSQLQSAPLPIVDKGPVELLEEFVFQVPKERSAQPKEQTKDSVRQIIFSSLFSPQGNKADDSRMSLLGKLVSMAVAVCRIPVLECAASWLQRTPVVYCVRLAKALVDDYCCLVPGSIQTLKQIFSASPRFCCQFITSVTALYDLSSDDLIPPMDLLEMIVTWIFEDPSVLQVLMTLQLHLTEKNLYGRLGLILFDHMVPLVEEINRLADELNPLNASQEIELSLDRLAQALQVAMASGALLCTRDDLRTLCSRLPHNNLLQLVISGPVQQSPHAALPPGFYPHIHTPPLGYGAVPAHPAAHPALPTHPGHTFISGVTFPFRPIR

SEQ ID NO: 16901 - protein, 149 aa, Homo sapiens
  Payload ID: 3372
  Gene Symbol: C7orf26
  Gene Name: chromosome 7 open reading frame 26
  ENSP ID: ENSP00000390166
  MOD_RES (1)..(1): Any amino acid
XNGHVSNKVTKDPGVGMDRDSHLLYSKLHLSVLQVLMTLQLHLTEKNLYGRLGLILFDHMVPLVEEINRLADELNPLNASQEIELSLDRLAQALQVAMASGALLCTRDDLRTLCSRLPHNKTLNFGVVCKASFLGLLLGIQVGRGHSRL

SEQ ID NO: 16902 - protein, 97 aa, Homo sapiens
  Payload ID: 3372
  Gene Symbol: C7orf26
  Gene Name: chromosome 7 open reading frame 26
  ENSP ID: ENSP00000396194
LFDHMVPLVEEINRLADELNPLNASQEIELSLDRLAQALQVAMASGALLCTRDDLRTLCSRLPHNKTVVRMRPSGVCEFLILLLATWRPPQTQSSGL

SEQ ID NO: 16903 - protein, 590 aa, Homo sapiens
  Payload ID: 3373
  Gene Symbol: C7orf31
  Gene Name: chromosome 7 open reading frame 31
  Uniprot ID: Q8N865
  ENSP ID: ENSP00000283905
MEVIHGRPYCCRELEGADILSNTFYSNELHNPLQTVTRPTASEDRYQELRESLQQCRLPWGAEREYGGIIPISLPEDHRPKYEPPRVMGKGHQHYGFGGETWPRKLPVEQFYYLTQNKKSDVYGNDSLIPKPPNSTVGEICLPYPIEHPYHTHICRGAMFPTFTSPEDLYTGIKARTQQPFPPTVPTKAYDSTVLKTRGNPYRYELIDIPMDSKKKALTWPGQGVYYDFPRGVEKNKPVFYPKPPKTFAPNTSLNSWDPICSAKEANIQRNLERSHWLTSYTHDFTGLGPMDPLELDDYHEKMVAELTRKIGFDPEPQEKFHPVFKPPRPLEGRIARLIQNRRSLEAIVQQRPRSCPDCTPRVLCNFHTFVPSSKEMVALSDNIPAGVTHKNQDIEEKIIEEQSLLSTYELPSCYPTKDLTSIYDIKPFPKITDTKKTEDLYWRQQSLKTQPTPYCKPDHWIHYENLKSPLRDQYNMCPDPVSLSKPSVLQNKQDTEAFTLEHFLSKPEEELFLNMENNEETRPVLGWIPRAGVTKPQTNLLELKNSFSKTGAQKRFHKSILEDHKDLRDNEHSGMKHQFYGHNSYYFYN

SEQ ID NO: 16904 - protein, 590 aa, Homo sapiens; identical to SEQ ID NO: 16903
  Payload ID: 3373
  Gene Symbol: C7orf31
  Gene Name: chromosome 7 open reading frame 31
  Uniprot ID: Q8N865
  ENSP ID: ENSP00000386604

SEQ ID NO: 16905 - protein, 153 aa, Homo sapiens
  Payload ID: 3373
  Gene Symbol: C7orf31
  Gene Name: chromosome 7 open reading frame 31
  ENSP ID: ENSP00000388472
MEVIHGRPYCCRELEGADILSNTFYSNELHNPLQTVTRPTASEDRYQELRESLQQCRLPWGAEREYGGIIPISLPEDHRPKYEPPRVMGKGHQHYGFGGETWPRKLPVEQFYYLTQNKKSDVYGNDSLIPKPPNSTVGEICLPYPIEHPYHTH

SEQ ID NO: 16906 - protein, 115 aa, Homo sapiens
  Payload ID: 3373
  Gene Symbol: C7orf31
  Gene Name: chromosome 7 open reading frame 31
  ENSP ID: ENSP00000391212
MEVIHGRPYCCRELEGADILSNTFYSNELHNPLQTVTRPTASEDRYQELRESLQQCRLPWGAEREYGGIIPISLPEDHRPKYEPPRVMGKGHQHYGFGGETWPRKLPVEQFYYLT

SEQ ID NO: 16907 - protein, 92 aa, Homo sapiens
  Payload ID: 3373
  Gene Symbol: C7orf31
  Gene Name: chromosome 7 open reading frame 31
  ENSP ID: ENSP00000403281
MEVIHGRPYCCRELEGADILSNTFYSNELHNPLQTVTRPTASEDRYQELRESLQQCRLPWGAEREYGGIIPISLPEDHRPKYEPPRVMGKGH

SEQ ID NO: 16908 - protein, 177 aa, Homo sapiens
  Payload ID: 3374
  Gene Symbol: C7orf33
  Gene Name: chromosome 7 open reading frame 33
  Uniprot ID: Q8WU49
  ENSP ID: ENSP00000304071
MQVEVQSLSLEECPWRLPGPQCECEALLPSGARRRIDLRLSGRAVAVWVHVRGGPGQFNLSYATGRHKKPNPHQNMNRGMEFIAPVSAPTKSGAPWHFLSQGPTDAQRAVRIRPGTRMGLSSDPVVGTLSSSYLDLLTLSYKPGRTVTSSYLNVRGHEVRKLQNSVEATRISRTDSS

SEQ ID NO: 16909 - protein, 147 aa, Homo sapiens
  Payload ID: 3375
  Gene Symbol: C7orf34
  Gene Name: chromosome 7 open reading frame 34
  Uniprot ID: Q96L11
  ENSP ID: ENSP00000386450
MGQEVHGSCWALGAGGGQRQWVGRSMPPLAPQLCRAVFLVPILLLLQVKPLNGSPGPKDGSQTEKTPSADQNQEQFEEHFVASSVGEMWQVVDMAQQEEDQSSKTAAVHKHSFHLSFCFSLASVMVFSGGPLRRTFPNIQLCFMLTH

SEQ ID NO: 16910 - protein, 153 aa, Homo sapiens
  Payload ID: 3375
  Gene Symbol: C7orf34
  Gene Name: chromosome 7 open reading frame 34
  Uniprot ID: Q96L11
  ENSP ID: ENSP00000401055
  MOD_RES (1)..(1): Any amino acid
XMTHCGHLGSLGHPCWLCSILVPRHWNALVSRNEVQAHGCDVTEHVKSEVLWKVKPLNGSPGPKDGSQTEKTPSADQNQEQFEEHFVASSVGEMWQVVDMAQQEEDQSSKTAAVHKHSFHLSFCFSLASVMVFSGGPLRRTFPNIQLCFMLTH

SEQ ID NO: 16911 - protein, 147 aa, Homo sapiens; identical to SEQ ID NO: 16909
  Payload ID: 3375
  Gene Symbol: C7orf34
  Gene Name: chromosome 7 open reading frame 34
  ENSP ID: ENSP00000484165

SEQ ID NO: 16912 - protein, 152 aa, Homo sapiens
  Payload ID: 3375
  Gene Symbol: C7orf34
  Gene Name: chromosome 7 open reading frame 34
  ENSP ID: ENSP00000488165
MTHCGHLGSLGHPCWLCSILVPRHWNALVSRNEVQAHGCDVTEHVKSEVLWKVKPLNGSPGPKDGSQTEKTPSADQNQEQFEEHFVASSVGEMWQVVDMAQQEEDQSSKTAAVHKHSFHLSFCFSLASVMVFSGGPLRRTFPNIQLCFMLTH

SEQ ID NO: 16913 - protein, 580 aa, Homo sapiens
  Payload ID: 3376
  Gene Symbol: C7orf43
  Gene Name: chromosome 7 open reading frame 43
  Uniprot ID: Q8WVR3
  ENSP ID: ENSP00000324741
MESQCDYSMYFPAVPLPPRAELAGDPGRYRALPRRNHLYLGETVRFLLVLRCRGGAGSGTGGGPGLGSRGAWAELATALAALASVSAGGGMPGGGGAGDQDSEPPGGGDPGGGGLFRGCSPLLTHGPGPATSGGATTLPVEEPIVSTDEVIFPLTVSLDRLPPGTPKAKIVVTVWKREIEAPEVRDQGYLRLLQTRSPGETFRGEQSAFKAQVSTLLTLLPPPVLRCRQFTVAGKHLTVLKVLNSSSQEEISIWDIRILPNFNASYLPVMPDGSVLLVDNVCHQSGEVSMGSFCRLPGTSGCFPCPLNALEEHNFLFQLRGGEQPPPGAKEGLEVPLIAVVQWSTPKLPFTQSIYTHYRLPSVRLDRPCFVMTASCKSPVRTYERFTVTYTLLNNLQDFLAVRLVWTPEHAQAGKQLCEEERRAMQAALDSVVCHTPLNNLGFSRKGSALTFSVAFQALRTGLFELSQHMKLKLQFTASVSHPPPEARPLSRKSSPSSPAVRDLVERHQASLGRSQSFSHQQPSRSHLMRSGSVMERRAITPPVASPVGRPLYLPPDKAVLSLDKIAKRECKVLVVEPVK

SEQ ID NO: 16914 - protein, 25 aa, Homo sapiens
  Payload ID: 3376
  Gene Symbol: C7orf43
  Gene Name: chromosome 7 open reading frame 43
  ENSP ID: ENSP00000377600
LQDFLAVRLVWTPEHAQAVYSTEWL

SEQ ID NO: 16915 - protein, 311 aa, Homo sapiens
  Payload ID: 3376
  Gene Symbol: C7orf43
  Gene Name: chromosome 7 open reading frame 43
  ENSP ID: ENSP00000389672
MPDGSVLLVDNVCHQSGEVSMGSFCRLPGTSGCFPCPLNALEEHNFLFQLRGGEQPPPGAKEGLEVPLIAVVQWSTPKLPFTQSIYTHYRLPSVRLDRPCFVMTASCKSPVRTYERFTVTYTLLNNLQDFLAVRLVWTPEHAQAGKQLCEEERRAMQAALDSVVCHTPLNNLGFSRKGSALTFSVAFQALRTGLFELSQHMKLKLQFTASVSHPPPEARPLSRKSSPSSPAVRDLVERHQASLGRSQSFSHQQPSRSHLMRSGSVMERRAITPPVASPVGRPLYLPPDKAVLSLDKIAKRECKVLVVEPVK

SEQ ID NO: 16916 - protein, 311 aa, Homo sapiens; identical to SEQ ID NO: 16915
  Payload ID: 3376
  Gene Symbol: C7orf43
  Gene Name: chromosome 7 open reading frame 43
  ENSP ID: ENSP00000396432

SEQ ID NO: 16917 - protein, 169 aa, Homo sapiens
  Payload ID: 3376
  Gene Symbol: C7orf43
  Gene Name: chromosome 7 open reading frame 43
  ENSP ID: ENSP00000399397
MESQCDYSMYFPAVPLPPRAELAGDPGRYRALPRRNHLYLGETVRFLLVLRCRGGAGSGTGGGPGLGSRGAWAELATALAALASVSAGGGMPGGGGAGDQDSEPPGGGDPGGGGLFRGCSPLLTHGPGPATSGGATTLPVEEPIVSTDEVIFPLTVSLDRLPPGTPKAK

SEQ ID NO: 16918 - protein, 150 aa, Homo sapiens
  Payload ID: 3376
  Gene Symbol: C7orf43
  Gene Name: chromosome 7 open reading frame 43
  ENSP ID: ENSP00000400075
  MOD_RES (1)..(1): Any amino acid
XPVMPDGSVLLVDNVCHQSGEVSMGSFCRLPGTSGCFPCPLNALEEHNFLFQLRGGEQPPPGAKEGLEVPLIAVVQWSTPKLPFTQSIYTHYRLPSVRLDRPCFVMTASCKSPVRTYERFTVTYTLLNNLQDFLAVRLVWTPEHAQAEWL

SEQ ID NO: 16919 - protein, 99 aa, Homo sapiens
  Payload ID: 3376
  Gene Symbol: C7orf43
  Gene Name: chromosome 7 open reading frame 43
  ENSP ID: ENSP00000406326
VVTVWKREIEAPEVRDQGYLRLLQTRSPGETFRGEQSAFKAQVSTLLTLLPPPVLRCRQFTVAGKHLTVLKGKQGCRLQPPGATRELIGCSSSGQAGGC

SEQ ID NO: 16920 - protein, 254 aa, Homo sapiens
  Payload ID: 3376
  Gene Symbol: C7orf43
  Gene Name: chromosome 7 open reading frame 43
  ENSP ID: ENSP00000483668
MHRLFTPQSGFENQMRLCWRRPCGNEERCSVCWSLFLPPGKQLCEEERRAMQAALDSVVCHTPLNNLGFSRKGSALTFSVAFQALRTGLFELSQHMKLKLQFTASVSHPPPEARPLSRKSSPSSPAVRDLVERHQASLGRSQSFSHQQPSRSHLMRSGSVMERRASRPLWPLLLAAPSTCPRTRLCCLWTRLPSASARSWWWNPSSSTVPALFPLTLQRPNAPRGDPCSRAVPPLGCLPDGGEEAWQSCLSCVC

SEQ ID NO: 16921 - protein, 157 aa, Homo sapiens
  Payload ID: 3377
  Gene Symbol: C7orf49
  Gene Name: chromosome 7 open reading frame 49
  Uniprot ID: Q9BWK5
  ENSP ID: ENSP00000376823
METLQSETKTRVLPSWLTAQVATKNVAPMKAPKRMRMAAVPVAAARLPATRTVYCMNEAEIVDVALGILIESRKQEKACEQPALAGADNPEHSPPCSVSPHTSSGSSSEEEDSGKQALAPGLSPSQRPGGSSSACSRSPEEEEEEDVLKYVREIFFS

SEQ ID NO: 16922 - protein, 156 aa, Homo sapiens
  Payload ID: 3377
  Gene Symbol: C7orf49
  Gene Name: chromosome 7 open reading frame 49
  ENSP ID: ENSP00000389941
MADSPGGYKECGTNEGPQEDENGSSASGSSKVRQLWSEDSCESGKLPATRTVYCMNEAEIVDVALGILIESRKQEKACEQPALAGADNPEHSPPCSVSPHTSSGSSSEEEDSGKQALAPGLSPSQRPGGSSSACSRSPEEEEEEDVLKYVREIFFS

SEQ ID NO: 16923 - protein, 102 aa, Homo sapiens
  Payload ID: 3377
  Gene Symbol: C7orf49
  Gene Name: chromosome 7 open reading frame 49
  Uniprot ID: Q9BWK5
  ENSP ID: ENSP00000400024
MNEAEIVDVALGILIESRKQEKACEQPALAGADNPEHSPPCSVSPHTSSGSSSEEEDSGKQALAPGLSPSQRPGGSSSACSRSPEEEEEEDVLKYVREIFFS

SEQ ID NO: 16924 - protein, 102 aa, Homo sapiens; identical to SEQ ID NO: 16923
  Payload ID: 3377
  Gene Symbol: C7orf49
  Gene Name: chromosome 7 open reading frame 49
  Uniprot ID: Q9BWK5
  ENSP ID: ENSP00000473365

SEQ ID NO: 16925 - protein, 69 aa, Homo sapiens
  Payload ID: 3377
  Gene Symbol: C7orf49
  Gene Name: chromosome 7 open reading frame 49
  ENSP ID: ENSP00000480430
METLQSETKTRVLPSWLTAQVATKNVAPMKAPKRMRMAAVPVAAARCDSSGQKTPANLTPCDKDCVLHE

SEQ ID NO: 16926 - protein, 102 aa, Homo sapiens; identical to SEQ ID NO: 16923
  Payload ID: 3377
  Gene Symbol: C7orf49
  Gene Name: chromosome 7 open reading frame 49
  Uniprot ID: Q9BWK5
  ENSP ID: ENSP00000481014

SEQ ID NO: 16927 - protein, 194 aa, Homo sapiens
  Payload ID: 3378
  Gene Symbol: C7orf50
  Gene Name: chromosome 7 open reading frame 50
  Uniprot ID: Q9BRJ6
  ENSP ID: ENSP00000350011
MAKQKRKVPEVTEKKNKKLKKASAEGPLLGPEAAPSGEGAGSKGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLEGLQGRARELTVQKAEALMRELDEEGSDPPLPGRAQRIRQVLQLLS

SEQ ID NO: 16928 - protein, 194 aa, Homo sapiens; identical to SEQ ID NO: 16927
  Payload ID: 3378
  Gene Symbol: C7orf50
  Gene Name: chromosome 7 open reading frame 50
  Uniprot ID: Q9BRJ6
  ENSP ID: ENSP00000380286

SEQ ID NO: 16929 - protein, 194 aa, Homo sapiens; identical to SEQ ID NO: 16927
  Payload ID: 3378
  Gene Symbol: C7orf50
  Gene Name: chromosome 7 open reading frame 50
  Uniprot ID: Q9BRJ6
  ENSP ID: ENSP00000380288

SEQ ID NO: 16930 - protein, 162 aa, Homo sapiens
  Payload ID: 3378
  Gene Symbol: C7orf50
  Gene Name: chromosome 7 open reading frame 50
  ENSP ID: ENSP00000396542
GPQDASTCFPLGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLEGLQGRARELTVQKAEALMRELDEEGSDPPLPGRAQRIRQVLQLLS

SEQ ID NO: 16931 - protein, 179 aa, Homo sapiens
  Payload ID: 3378
  Gene Symbol: C7orf50
  Gene Name: chromosome 7 open reading frame 50
  ENSP ID: ENSP00000407380
  MOD_RES (1)..(1): Any amino acid
XAGRAVRTAGASLPRRRPCPRDLTAGSEGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLEGLQGRARELTVQKAEALMRELDEEGSDPPLPGRAQRIRQVLQLLS

SEQ ID NO: 16932 - protein, 192 aa, Homo sapiens
  Payload ID: 3378
  Gene Symbol: C7orf50
  Gene Name: chromosome 7 open reading frame 50
  ENSP ID: ENSP00000420130
MAKQKRKVPEVTEKKNKKLKKASAEGPLLGPEAAPSGEGAGSKGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLEGLQGRARELTVQKAEALMRELDEEGSDPPLPGRAQRIRQVLQL

SEQ ID NO: 16933 - protein, 113 aa, Homo sapiens
  Payload ID: 3379
  Gene Symbol: C7orf55
  Gene Name: chromosome 7 open reading frame 55
  Uniprot ID: Q96HJ9
  ENSP ID: ENSP00000297534
MAALGSPSHTFRGLLRELRYLSAATGRPYRDTAAYRYLVKAFRAHRVTSEKLCRAQHELHFQAATYLCLLRSIRKHVALHQEFHGKGERSVEESAGLVGLKLPHQPGGKGWEP

SEQ ID NO: 16934 - protein, 295 aa, Homo sapiens
  Payload ID: 3380
  Gene Symbol: C7orf57
  Gene Name: chromosome 7 open reading frame 57
  Uniprot ID: Q8NEG2
  ENSP ID: ENSP00000335500
MRNTSKELQGATHRYAPCDWYYHVPVKRSEKAVDAPPASQIPGLSNLGDSHSENLPGTRRYWIKETDSEYVKLAKQGGRPDLLKHFAPGTRKGSPVAYSLPDWYIHHSKPPTASQQEVRAVSMPDYMVHEEFNPDQANGSYASRRGPFDFDMKTVWQREAEELEKEKKKLRLPAIDSKYLSKAGTPLGPKNPAGSRLSFPPVPGQKNSSPTNFSKLISNGYKDEWLQQQQRADSDKRTPKTSRASVLSQSPRDLEGPQDAARLQDAEASEGPEDTPESSQSPEESVSASTPAELK

SEQ ID NO: 16935 - protein, 153 aa, Homo sapiens
  Payload ID: 3380
  Gene Symbol: C7orf57
  Gene Name: chromosome 7 open reading frame 57
  Uniprot ID: Q8NEG2
  ENSP ID: ENSP00000391652
MPDYMVHEEFNPDQANGSYASRRGPFDFDMKTVWQREAEELEKEKKKLRLPAIDSKYLSKAGTPLGPKNPAGSRLSFPPVNGYKDEWLQQQQRADSDKRTPKTSRASVLSQSPRDLEGPQDAARLQDAEASEGPEDTPGPEESVSASTPAELK

SEQ ID NO: 16936 - protein, 324 aa, Homo sapiens
  Payload ID: 3380
  Gene Symbol: C7orf57
  Gene Name: chromosome 7 open reading frame 57
  ENSP ID: ENSP00000394648
MLWFRGALGVWVWLAAASQPCKNSNAGRRGQHPRRPAGSCVQRLTMRNTSKELQGATHRYAPCDWYYHVPVKRSEKAVDAPPASQIPGLSNLGDSHSENLPGTRRYWIKETDSEYVKLAKQGGRPDLLKHFAPGTRKGSPVAYSLPDWYIHHSKPPTASQQEVRAVSMPDYMVHEEFNPDQANGSYASRRGPFDFDMKTVWQREAEELEKEKKKLRLPAIDSKYLSKAGTPLGPKNPAGSRLSFPPVNGYKDEWLQQQQRADSDKRTPKTSRASVLSQSPRDLEGPQDAARLQDAEASEGPEDTPESSQSPEESVSASTPAELK

SEQ ID NO: 16937 - protein, 340 aa, Homo sapiens
  Payload ID: 3380
  Gene Symbol: C7orf57
  Gene Name: chromosome 7 open reading frame 57
  ENSP ID: ENSP00000410944
MLWFRGALGVWVWLAAASQPCKNSNAGRRGQHPRRPAGSCVQRLTMRNTSKELQGATHRYAPCDWYYHVPVKRSEKAVDAPPASQIPGLSNLGDSHSENLPGTRRYWIKETDSEYVKLAKQGGRPDLLKHFAPGTRKGSPVAYSLPDWYIHHSKPPTASQQEVRAVSMPDYMVHEEFNPDQANGSYASRRGPFDFDMKTVWQREAEELEKEKKKLRLPAIDSKYLSKAGTPLGPKNPAGSRLSFPPVPGQKNSSPTNFSKLISNGYKDEWLQQQQRADSDKRTPKTSRASVLSQSPRDLEGPQDAARLQDAEASEGPEDTPESSQSPEESVSASTPAELK

SEQ ID NO: 16938 - protein, 157 aa, Homo sapiens
  Payload ID: 3380
  Gene Symbol: C7orf57
  Gene Name: chromosome 7 open reading frame 57
  ENSP ID: ENSP00000442474
MPDYMVHEEFNPDQANGSYASRRGPFDFDMKTVWQREAEELEKEKKKLRLPAIDSKYLSKAGTPLGPKNPAGSRLSFPPVNGYKDEWLQQQQRADSDKRTPKTSRASVLSQSPRDLEGPQDAARLQDAEASEGPEDTPESSQSPEESVSASTPAELK

SEQ ID NO: 16939 - protein, 405 aa, Homo sapiens
  Payload ID: 3381
  Gene Symbol: C7orf60
  Gene Name: chromosome 7 open reading frame 60
  Uniprot ID: Q1RMZ1
  ENSP ID: ENSP00000297145
MEPGAGGRNTARAQRAGSPNTPPPREQERKLEQEKLSGVVKSVHRRLRKKYREVGDFDKIWREHCEDEETLCEYAVAMKNLADNHWAKTCEGEGRIEWCCSVCREYFQNGGKRKALEKDEKRAVLATKTTPALNMHESSQLEGHLTNLSFTNPEFITELLQASGKIRLLDVGSCFNPFLKFEEFLTVGIDIVPAVESVYKCDFLNLQLQQPLQLAQDAIDAFLKQLKNPIDSLPGELFHVVVFSLLLSYFPSPYQRWICCKKAHELLVLNGLLLIITPDSSHQNRHAMMMKSWKIAIESLGFKRFKYSKFSHMHLMAFRKISLKTTSDLVSRNYPGMLYIPQDFNSIEDEEYSNPSCYVRSDIEDEQLAYGFTELPDAPYDSDSGESQASSIPFYELEDPILLLS

SEQ ID NO: 16940 - protein, 387 aa, Homo sapiens
  Payload ID: 3381
  Gene Symbol: C7orf60
  Gene Name: chromosome 7 open reading frame 60
  ENSP ID: ENSP00000408654
RRLRKKYREVGFKHSCFKILTKSKTLRNFEQILFSMGDFDKIWREHCEDEETLCEYAVAMKNLADNHWAKTCEGEGRIEWCCSVCREYFQNGGKRKALEKDEKRAVLATKTTPALNMHESSQLEGHLTNLSFTNPEFITELLQASGKIRLLDVGSCFNPFLKFEEFLTVGIDIVPAVESVYKCDFLNLQLQQPLQLAQDAIDAFLKQLKNPIDSLPGELFHVVVFSLLLSYFPSPYQRWICCKKAHELLVLNGLLLIITPDSSHQNRHAMMMKSWKIAIESLGFKRFKYSKFSHMHLMAFRKISLKTTSDLVSRNYPGMLYIPQDFNSIEDEEYSNPSCYVRSDIEDEQLAYGFTELPDAPYDSDSGESQASSIPFYELEDPILLLS

SEQ ID NO: 16941 - protein, 206 aa, Homo sapiens
  Payload ID: 3382
  Gene Symbol: C7orf61
  Gene Name: chromosome 7 open reading frame 61
  Uniprot ID: Q8IZ16
  ENSP ID: ENSP00000327732
MVVVMKFFRWVRRAWQRIISWVFFWRQKIKPTISGHPDSKKHSLKKMEKTLQVVETLRLVELPKEAKPKLGESPELADPCVLAKTTEETEVELGQQGQSLLQLPRTAVKSVSTLMVSALQSGWQMCSWKSSVSSASVSSQVRTQSPLKTPEAELLWEVYLVLWAVRKHLRRLYRRQERHRRHHVRCHAAPRPNPAQSLKLDAQSPL

SEQ ID NO: 16942 - protein, 191 aa, Homo sapiens
  Payload ID: 3382
  Gene Symbol: C7orf61
  Gene Name: chromosome 7 open reading frame 61
  ENSP ID: ENSP00000412290
  MOD_RES (1)..(1): Any amino acid
XLACGQTRWSGEEGKDSWGGAGGEGREARKLTAPSLLCLLFCGWCCLCPAPLSCLSSLCLGSQVFFWRQKIKPTISGHPDSKKHSLKKMEKTLQVVETLRLVELPKEAKPKLGESPELADPCVLAKTTEETEVELGQQGQSLLQLPRTAVKSVSTLMVSALQSGWQMCSWKSSVSSASVSSQVRTQSPLKT

SEQ ID NO: 16943 - protein, 253 aa, Homo sapiens
  Payload ID: 3383
  Gene Symbol: C7orf62
  Gene Name: chromosome 7 open reading frame 62
  Uniprot ID: Q8TBZ9
  ENSP ID: ENSP00000297203
MSFSVHNQKGSKRPLPLEPLLFLQVPRSNYLHFQEEKQRLHLKKFLLDRMFLVAKIQANVERKDVADYYEQMFQSVLKHHLGEAVTGLLLIYPTSILHILESSSDTLYKVLLDYIGHVKDETVFFIQQMKIIVISHNIPMRLFMQWHVSVIKVPVMYLDDVTQSQSLKEVITDFLTQTHKLSLYLCQTMKVGTKGPGDNLHQVAPDLLLPEQIIKYLCKSEEFMDPATFINMYNRPIHITLDSEVVWPAPSRF

SEQ ID NO: 16944 - protein, 438 aa, Homo sapiens
  Payload ID: 3384
  Gene Symbol: C7orf72
  Gene Name: chromosome 7 open reading frame 72
  Uniprot ID: A4D263
  ENSP ID: ENSP00000297001
MDVEIQDTPGKISISKRSILSGTVENIDYPHYCDLLRKMNMPFVKGLENRHNYGRFEKKCNPAFLKFHPYPPSVLPDYHLHDPYPPPYGPHYPLFPLRDDVTLGDSCSGFMSPGGDADLNPGIGRTIPTLVDFSDVKPQHRVPRPDTGFQTTIKRQKILSEELQQNRRWNSREVPDISIRARLGGWTSPLKVTPLQPHHEGRSLSHIFTFDEEATCTDEGEPLVQTNKKCNAKDSFYKSSTQKAYEDVPWDKMLPPKLVPEETTLEKTADPISQCFTLKRYKGVPAITQMVGELWDRFQTRSFLAPVKPINFVSSSSRSKYIPLYTGHVQSTNADDVDNPLGDIASLAKQRYSKPLYTNTSRAANIPGYTGKVHFTATHPANSNIPSTTPSPDSELHRVFQKEMAVDLFRHQAPLSRLVTTVRPYNPFNKKDKETIDY

SEQ ID NO: 16945 - protein, 47 aa, Homo sapiens
  Payload ID: 3385
  Gene Symbol: C7orf73
  Gene Name: chromosome 7 open reading frame 73
  Uniprot ID: E0CX11
  ENSP ID: ENSP00000425996
MLQFLLGFTLGNVVGMYLAQNYDIPNLAKKLEEIKKDLDAKKKPPSA

SEQ ID NO: 16946 - protein, 45 aa, Homo sapiens
  Payload ID: 3385
  Gene Symbol: C7orf73
  Gene Name: chromosome 7 open reading frame 73
  ENSP ID: ENSP00000485469
MLQFLLGFTLGNVVGMYLAQNYDGIGSPSVSQAGVQWWDLGSLQL

SEQ ID NO: 16947 - protein, 90 aa, Homo sapiens
  Payload ID: 3386
  Gene Symbol: C7orf77
  Gene Name: chromosome 7 open reading frame 77
  Uniprot ID: A4D0Y5
  ENSP ID: ENSP00000480627
MGAERVCTKAPEITQDEAEIYSLTNMEGNIGIKGCEFKSWLFKFYQARSQVLLCGEVKNPYLLTSNKTTVKEQNACLTHPDRSAMAGLLL

SEQ ID NO: 16948 - protein, 84 aa, Homo sapiens
  Payload ID: 3387
  Gene Symbol: C8orf22
  Gene Name: chromosome 8 open reading frame 22
  Uniprot ID: Q8WWR9
  ENSP ID: ENSP00000304926
MASVPSIGCLLARNQYYRKSSVSSVSSLTSSDSVNFIDDDKPQQGLPEVAESTWWFKSFFHSEPVLSNVRIKDLSATGSLSGRS

SEQ ID NO: 16949 - protein, 81 aa, Homo sapiens
  Payload ID: 3387
  Gene Symbol: C8orf22
  Gene Name: chromosome 8 open reading frame 22
  Uniprot ID: Q8WWR9
  ENSP ID: ENSP00000382561
MASVPSIGCLLARNQYYRKSSVSSVSSLTSSDSVNFIDDDKPQQGLPEVAESTWWFKSFFHSEPVLSNVRIKDLSATGMNS

SEQ ID NO: 16950 - protein, 84 aa, Homo sapiens
  Payload ID: 3387
  Gene Symbol: C8orf22
  Gene Name: chromosome 8 open reading frame 22
  Uniprot ID: Q8WWR9
  ENSP ID: ENSP00000428773
MASVPSIGCLLARNQYYRKSSVSSVSSLTSSDSVNFIDDDKPQQGLPEVAESTWWFKSFFHSEPVLSNVRIKDLSATGLQMSTL

SEQ ID NO: 16951 - protein, 84 aa, Homo sapiens; identical to SEQ ID NO: 16950
  Payload ID: 3387
  Gene Symbol: C8orf22
  Gene Name: chromosome 8 open reading frame 22
  Uniprot ID: Q8WWR9
  ENSP ID: ENSP00000430392

SEQ ID NO: 16952 - protein, 229 aa, Homo sapiens
  Payload ID: 3388
  Gene Symbol: C8orf33
  Gene Name: chromosome 8 open reading frame 33
  Uniprot ID: Q9H7E9
  ENSP ID: ENSP00000330361
MAALGHLAGEAAAAPGPGTPCASRGARLPGPVSSARNPSTVCLCPEQPTCSNADSRAHPLGDEGGTASKKQKNKKKTRNRASVANGGEKASEKLAPEEVPLSAEAQAQQLAQELAWCVEQLELGLKRQKPTPKQKEQAIGAIRTLRSKRTPLPRKRQLMHSLFGDYRAQMEAEWREALRALRAAAYSAQVQPVDGATRKKSQRVCRPRSIWRAKATLDMPDEEFRFNFF

SEQ ID NO: 16953 - protein, 201 aa, Homo sapiens
  Payload ID: 3389
  Gene Symbol: C8orf34
  Gene Name: chromosome 8 open reading frame 34
  Uniprot ID: Q49A92
  ENSP ID: ENSP00000319532
MENGFTMCQTGRQHPVACGLHLSGGKEDLNDLRMEGVTTLVPSGSKFNQGRPTYPAEPQAKVTLNICSRCARLQGDNLEERTEESLPILHSPDEKIPDSFDSLPGTEEALMEEGDEFEKASKLTGPGEASSGVGHSLKNYMEEDESLKQLQVVHQPWILPSDTESEGVEAEQEKHLLNQNLCGWDSEFCIFHTLASFLIYK

SEQ ID NO: 16954 - protein, 427 aa, Homo sapiens
  Payload ID: 3389
  Gene Symbol: C8orf34
  Gene Name: chromosome 8 open reading frame 34
  Uniprot ID: Q49A92
  ENSP ID: ENSP00000337174
MTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLEDLNDLRMEGVTTLVPSGSKFNQGRPTYPAEPQAKVTLNICSRCARLQGDNLEERTEESLPILHSPDEKIPDSFDSLPGTEEALMEEGDEFEKASKLTGPGEASSGVGHSLKNYMEEDESLKQLQVVHQPWILPSDTESEGVEAEQEKRSADLLLCVPCSSCPTLVYSGL

SEQ ID NO: 16955 - protein, 287 aa, Homo sapiens
  Payload ID: 3389
  Gene Symbol: C8orf34
  Gene Name: chromosome 8 open reading frame 34
  ENSP ID: ENSP00000345255
MASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLGNFKN

SEQ ID NO: 16956 - protein, 538 aa, Homo sapiens
  Payload ID: 3389
  Gene Symbol: C8orf34
  Gene Name: chromosome 8 open reading frame 34
  Uniprot ID: Q49A92
  ENSP ID: ENSP00000427820
MSSPLASELSELAALRPGFRLSAPHARVAPRAATHARGRGRASHAGQPRLRSSCPGPSPGKRRVVPSGGAQPRVLPALSSRSHLFPMASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLEDLNDLRMEGVTTLVPSGSKFNQGRPTYPAEPQAKVTLNICSRCARLQGDNLEERTEESLPILHSPDEKIPDSFDSLPGTEEALMEEGDEFEKASKLTGPGEASSGVGHSLKNYMEEDESLKQLQVVHQPWILPSDTESEGVEAEQEKRSADLLLCVPCSSCPTLVYSGL

SEQ ID NO: 16957 - protein, 206 aa, Homo sapiens
  Payload ID: 3389
  Gene Symbol: C8orf34
  Gene Name: chromosome 8 open reading frame 34
  ENSP ID: ENSP00000429081
MTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLEDT

SEQ ID NO: 16958 - protein, 129 aa, Homo sapiens
  Payload ID: 3389
  Gene Symbol: C8orf34
  Gene Name: chromosome 8 open reading frame 34
  Uniprot ID: Q49A92
  ENSP ID: ENSP00000429102
MASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSCKEVSYSNAIQSM

SEQ ID NO: 16959 - protein, 207 aa, Homo sapiens
  Payload ID: 3390
  Gene Symbol: C8orf37
  Gene Name: chromosome 8 open reading frame 37
  Uniprot ID: Q96NL8
  ENSP ID: ENSP00000286688
MAEDLDELLDEVESKFCTPDLLRRGMVEQPKGCGGGTHSSDRNQAKAKETLRSTETFKKEDDLDSLINEILEEPNLDKKPSKLKSKSSGNTSVRASIEGLGKSCSPVYLGGSSIPCGIGTNISWRACDHLRCIACDFLVVSYDDYMWDKSCDYLFFRNNMPEFHKLKAKLIKKKGTRAYACQCSWRTIEEVTDLQTDHQLRWVCGKH

SEQ ID NO: 16960 - protein, 106 aa, Homo sapiens
  Payload ID: 3391
  Gene Symbol: C8orf4
  Gene Name: chromosome 8 open reading frame 4
  Uniprot ID: Q9NR00
  ENSP ID: ENSP00000319914
MKAKRSHQAVIMSTSLRVSPSIHGYHFDTASRKKAVGNIFENTDQESLERLFRNSGDKKAEERAKIIFAIDQDVEEKTRALMALKKRTKDKLFQFLKLRKYSIKVH

SEQ ID NO: 16961 - protein, 159 aa, Homo sapiens
  Payload ID: 3392
  Gene Symbol: C8orf44
  Gene Name: chromosome 8 open reading frame 44
  Uniprot ID: Q96CB5
  ENSP ID: ENSP00000375087
MRKNESYLNQPAPPIPIPTLSLMGGCREHFENHWKGRARWLMPVIPALWEAKAGRSPEVRSSKPAWPTWRNPIFTKNTKISQVLELFLNYQSLICALEKQKRQKGSLAIFCWSFQGGCVSKRPDVPSLKSQKPKRKRITGRKRLSKGFWSLLFSNLGRF

SEQ ID NO: 16962 - protein, 159 aa, Homo sapiens; identical to SEQ ID NO: 16961
  Payload ID: 3392
  Gene Symbol: C8orf44
  Gene Name: chromosome 8 open reading frame 44
  Uniprot ID: Q96CB5
  ENSP ID: ENSP00000428002

SEQ ID NO: 16963 - protein, 85 aa, Homo sapiens
  Payload ID: 3392
  Gene Symbol: C8orf44
  Gene Name: chromosome 8 open reading frame 44
  ENSP ID: ENSP00000431104
MRKNESYLNQPAPPIPIPTLSLMGGCREHFENHWKGRARWLMPVIPALWEAKAGRSPEVRSSKPAWPTWRNPIFTKNTKISQVIL

SEQ ID NO: 16964 - protein, 207 aa, Homo sapiens
  Payload ID: 3393
  Gene Symbol: C8orf46
  Gene Name: chromosome 8 open reading frame 46
  Uniprot ID: Q8TAG6
  ENSP ID: ENSP00000302260
MMHQIYSCSDENIEVFTTVIPSKVSSPARRRAKSSQHLLTKNVVIESDLYTHQPLELLPHRGDRRDPGDRRRFGRLQTARPPTAHPAKASARPVGISEPKTSNLCGNRAYGKSLIPPVPRISVKTSASASLEATAMGTEKGAVLMRGSRHLKKMTEEYPALPQGAEASLPLTGSASCGVPGILRKMWTRHKKKSEYVGATNSAFEAD

SEQ ID NO: 16965 - protein, 147 aa, Homo sapiens
  Payload ID: 3393
  Gene Symbol: C8orf46
  Gene Name: chromosome 8 open reading frame 46
  ENSP ID: ENSP00000429883
MMHQIYSCSDENIEVFTTVIPSKVSSPARRRAKSSQHLLTKNVVIESDLYTHQPLELLPHRGDRRDPGDRRRFGRLQTARPPTAHPAKASARPVGISEPKTSNLCGNRAYGKSLIPPVPRISVKTSASASLEATAMGTEKGAVLMRG

SEQ ID NO: 16966 - protein, 134 aa, Homo sapiens
  Payload ID: 3393
  Gene Symbol: C8orf46
  Gene Name: chromosome 8 open reading frame 46
  Uniprot ID: Q8TAG6
  ENSP ID: ENSP00000430141
MMHQIYSCSDENIEVFTTVIPSKVSSPARRRAKSSQHLLTKNVVIESDLYTHQPLELLPHRGDRRDPGDRRRFGRLQTARPPTAHPAKASARPDTASAPDLSENFSLCLIGGDSHGHREGSCSDERIQTSQEDD

SEQ ID NO: 16967 - protein, 77 aa, Homo sapiens
  Payload ID: 3393
  Gene Symbol: C8orf46
  Gene Name: chromosome 8 open reading frame 46
  ENSP ID: ENSP00000430388
MMHQIYSCSDENIEVFTTVIPSKVSSPARRRAKSSQHLLTKNILSLFLEFTGITKDPETPSMRAPSAKLLPWGSMGP

SEQ ID NO: 16968 - protein, 122 aa, Homo sapiens
  Payload ID: 3393
  Gene Symbol: C8orf46
  Gene Name: chromosome 8 open reading frame 46
  ENSP ID: ENSP00000430501
MMHQIYSCSDENIEVFTTVIPSKVSSPARRRAKSSQHLLTKNVVIESDLYTHQPLELLPHRGDRRDPGDRRRFGRLQTARPPTAHPAKASARPVGISEPKTSNLCGNRAYGKSLIQTSQEDD

SEQ ID NO: 16969 - protein, 48 aa, Homo sapiens
  Payload ID: 3393
  Gene Symbol: C8orf46
  Gene Name: chromosome 8 open reading frame 46
  ENSP ID: ENSP00000473681
MMHQIYSCSDENIEVFTTVIPSKVSSPARRRAKSSQHLLTKNTLLDQG

SEQ ID NO: 16970 - protein, 319 aa, Homo sapiens
  Payload ID: 3394
  Gene Symbol: C8orf48
  Gene Name: chromosome 8 open reading frame 48
  Uniprot ID: Q96LL4
  ENSP ID: ENSP00000297324
MAICPELAQTDKSALANLSDETETLKNSTDEVQTSSSFSSSGGRQSSPLTSGSKLEREKQTPSLEQGDTQSELLDYKNYEKKLSKKWINYLKLKDSNFERHQPDTKLPTEITRVSDEELNALQSYCTMKINLIHRRGDSKKKTSSRHKKLHLGLDVEASERDAFSCTVPDELLNRIYFKNMRTTPKQEAAAKQHISYQCPYCNRKRAELALSAFLKQKKTLLESFLLQERIDEHLHTKDFLTRIGEAHQDFPRLSDDPRIIWKRLTEKSHIRYSGFERSETEQKLQRDGNSACHLPFSLPFLKRLTLIKPELVIVNDNV

SEQ ID NO: 16971 - protein, 365 aa, Homo sapiens
  Payload ID: 3395
  Gene Symbol: C8orf58
  Gene Name: chromosome 8 open reading frame 58
  Uniprot ID: Q8NAV2
  ENSP ID: ENSP00000289989
MMGRRRAFAVDGRDGAGEGLARGCIVPGVTSTYRRIPDAAHGCSSWERGDKFRGVGREALFLKLASRDSGVEMAVGDSPLAALPGLSQDSLDFESSGSSEPPAQVGRLLASQKLGEVLERSRRLPTAPTSLSGQHRSLRLASKPEREVPLGAGQQESMEADTDLEAGLEEEAVGGLGPGAWACLPGQGLRYLEHLCLVLEQMARLQQLYLQLRIQRPPGDPGEEESTRAPLPSPLHTPGNRGQGPWELLSQTEHTGAKAASPPKVEVPSANPPRLPETPVEPTYHLPSSQGHKRDISHWDKVKVLLNRICRRSHHHPEPPAPPDGSDPRIESRDLPERPQCRPHRKTFMPSLVVKKQRAKNLSVG

SEQ ID NO: 16972 - protein, 357 aa, Homo sapiens
  Payload ID: 3395
  Gene Symbol: C8orf58
  Gene Name: chromosome 8 open reading frame 58
  Uniprot ID: Q8NAV2
  ENSP ID: ENSP00000386265
MMGRRRAFAVDGRDGAGEGLARGCIVPGVTSTYRRIPDAAHGCSSWERGDKFRGVGREALFLKLASRDSGVEMAVGDSPLAALPGLSQDSLDFESSGSSEPPAQVGRLLASQKLGEVLERSRRLPTAPTSLSGQHRSLRLASKPEREVPLGAGQQESMEADTDLEAGLEEEAVGGLGPGAWACLPGQGLRYLEHLCLVLEQMARLQQLYLQLRIQRPPGDPGEEESTRAPLPSPLHTPGNRGQGPWELLSQTEHTGAKAASPPKVEVPSANPPRLPETPVEPTYHLPSSQGHKVKVLLNRICRRSHHHPEPPAPPDGSDPRIESRDLPERPQCRPHRKTFMPSLVVKKQRAKNLSVG

SEQ ID NO: 16973 - protein, 148 aa, Homo sapiens
  Payload ID: 3395
  Gene Symbol: C8orf58
  Gene Name: chromosome 8 open reading frame 58
  ENSP ID: ENSP00000428292
MARLQQLYLQLRIQRPPGDPGEEESTRAPLPSPLHTPGNRGQGPWELLSQTEHTGEGPSCLPLSCLPGVPPAGPLSRSLMGCLLALANLTVFLKEQRLLHPQRWRCPVPTLPGCQKPQWSQRTTCHPPRDTSGISPTGTRSRSCSTGS

SEQ ID NO: 16974 - protein, 175 aa, Homo sapiens
  Payload ID: 3395
  Gene Symbol: C8orf58
  Gene Name: chromosome 8 open reading frame 58
  ENSP ID: ENSP00000428335
  MOD_RES (1)..(1): Any amino acid
XFTVPVTHPRQSGAGAMGAAKPDRAHRSKGCFTPKGGGAQCQPSQAARNPSGANVPLAILPGTQGRGQVYVGQVVGWGGGRGGGGCMGTLGASNSGEMTGLIPVWSRRLVLAVATAVSGSLVGGLSVGRALGDPSSSAQRDISHWDKVKVLLNRICRRSHHHPEPPAPPDGSDPR

SEQ ID NO: 16975 - protein, 300 aa, Homo sapiens
  Payload ID: 3395
  Gene Symbol: C8orf58
  Gene Name: chromosome 8 open reading frame 58
  ENSP ID: ENSP00000480712
MMGRRRAFAVDGRDGAGEGLARGCIVPGVTSTYRRIPDAAHGCSSWERGDKFRGVGREALFLKLASRDSGVEMAVGDSPLAALPGLSQDSLDFESSGSSEPPAQVGRLLASQKLGEVLERSRRLPTAPTSLSGQHRSLRLASKPEREVPLGAGQQESMEADTDLEAGLEEEAVGGLGPGAWACLPGQGLRYLEHLCLVLEQMARLQQLYLQLRIQRPPGDPGEEESTRAPLPSPLHTPGNRGQGPWELLSQTEHTGAKAASPPKVEVPSANPPRLPETPVEPTYHLPSSQGHKDRVQGPP

SEQ ID NO: 16976 - protein, 328 aa, Homo sapiens
  Payload ID: 3395
  Gene Symbol: C8orf58
  Gene Name: chromosome 8 open reading frame 58
  ENSP ID: ENSP00000482344
MAVGDSPLAALPGLSQDSLDFESSGSSEPPAQVGRLLASQKLGEVLERSRRLPTAPTSLSGQHRSLRLASKPEREVPLGAGQQESMEADTDLEAGLEEEAVGGLGPGAWACLPGQGLRYLEHLCLVLEQMARLQQLYLQLRIQRPPGDPGEEESTRAPLPSPLHTPGNRGQGPWELLSQTEHTGAKAASPPKVEVPSANPPRLPETPVEPTYHLPSSQGHKRDISHWDKVKVLLNRICRRSHHHPEPPAPPDGSDPRIESRDLPERPQCRPHRKTFMPSLVVKKQRAKPFCRLRPLGAPGDPGWRGLAVKSSSPSALLLLLHIARKSC

SEQ ID NO: 16977 - protein, 43 aa, Homo sapiens
  Payload ID: 3396
  Gene Symbol: C8orf59
  Gene Name: chromosome 8 open reading frame 59
  Uniprot ID: Q8N0T1
  ENSP ID: ENSP00000319020
MAKNKLRGPKSRNVFHIASQKNFKAKNKAKPVTTNLKKVLHFS

SEQ ID NO: 16978 - protein, 45 aa, Homo sapiens
  Payload ID: 3396
  Gene Symbol: C8orf59
  Gene Name: chromosome 8 open reading frame 59
  ENSP ID: ENSP00000428722
MAKNKLRGPKSRNVFHIASQKNFKAKNKAKPVTTNLKKINIMNEE

SEQ ID NO: 16979 - protein, 61 aa, Homo sapiens
  Payload ID: 3396
  Gene Symbol: C8orf59
  Gene Name: chromosome 8 open reading frame 59
  ENSP ID: ENSP00000444092
MAKNKLRGPKSRNVFHIASQKNFKAKNKAKPVTTNLKKIPQQRHESKPVNVDEATRLMALL

SEQ ID NO: 16980 - protein, 61 aa, Homo sapiens; identical to SEQ ID NO: 16979
  Payload ID: 3396
  Gene Symbol: C8orf59
  Gene Name: chromosome 8 open reading frame 59
  ENSP ID: ENSP00000480167

SEQ ID NO: 16981 - protein, 100 aa, Homo sapiens
  Payload ID: 3396
  Gene Symbol: C8orf59
  Gene Name: chromosome 8 open reading frame 59
  Uniprot ID: Q8N0T1
  ENSP ID: ENSP00000481745
MAKNKLRGPKSRNVFHIASQKNFKAKNKAKPVTTNLKKINIMNEEKVNRVNKAFVNVQKELAHFAKSISLEPLQKELIPQQRHESKPVNVDEATRLMALL

SEQ ID NO: 16982 - protein, 100 aa, Homo sapiens; identical to SEQ ID NO: 16981
  Payload ID: 3396
  Gene Symbol: C8orf59
  Gene Name: chromosome 8 open reading frame 59
  Uniprot ID: Q8N0T1
  ENSP ID: ENSP00000482944

SEQ ID NO: 16983 - protein, 100 aa, Homo sapiens; identical to SEQ ID NO: 16981
  Payload ID: 3396
  Gene Symbol: C8orf59
  Gene Name: chromosome 8 open reading frame 59
  Uniprot ID: Q8N0T1
  ENSP ID: ENSP00000484101

SEQ ID NO: 16984 - protein, 100 aa, Homo sapiens; identical to SEQ ID NO: 16981
  Payload ID: 3396
  Gene Symbol: C8orf59
  Gene Name: chromosome 8 open reading frame 59
  Uniprot ID: Q8N0T1
  ENSP ID: ENSP00000484492

SEQ ID NO: 16985 - protein, 100 aa, Homo sapiens; identical to SEQ ID NO: 16981
  Payload ID: 3396
  Gene Symbol: C8orf59
  Gene Name: chromosome 8 open reading frame 59
  Uniprot ID: Q8N0T1
  ENSP ID: ENSP00000484811

SEQ ID NO: 16986 - protein, 294 aa, Homo sapiens
  Payload ID: 3397
  Gene Symbol: C8orf74
  Gene Name: chromosome 8 open reading frame 74
  Uniprot ID: Q6P047
  ENSP ID: ENSP00000307129
MALLTPQGVKEVFQLQRPQGRERLRRLLNWEEFDEQRDSRRSILLDTLYESIIFAVGKGFPWVEVAQVVKFTEELLRETKGCSITEAVTILGNKLRDYRGHFNTTHLLALCDYFHHTFIRHYKLYQYVLGQDQQVDLTVAHLEVCMPPHPLPLAEGMDRDLWIHEQQVATLTEAEAQKRADVLLLKEALRLERENSLQKAFAAAAPAQPGQVLERQELESLICQAVHTQMELLQELLQRQIQNTFAILDLKLQKKTLNLNAPTPIPPPITSHAGQEEALKPQRASKGKKAKARK

SEQ ID NO: 16987 - protein, 99 aa, Homo sapiens
  Payload ID: 3397
  Gene Symbol: C8orf74
  Gene Name: chromosome 8 open reading frame 74
  ENSP ID: ENSP00000429505
  MOD_RES (1)..(1): Any amino acid
XLLTPQGVKEVFQLQRPQGRERLRRLLNWEEFDEQRDSRRSILLDTLYESIIFAVGKGFPWVEVAQVVKFTEELLRETKGAGLQGLGDHLQEVPSSQCK

SEQ ID NO: 16988 - protein, 99 aa, Homo sapiens
  Payload ID: 3397
  Gene Symbol: C8orf74
  Gene Name: chromosome 8 open reading frame 74
  ENSP ID: ENSP00000430613
MALLTPQGVKEVFQLQRPQGRERLRRLLNWEEFDEQRDSRRSILLDTLYESIIFAVGKGFPWVEVAQVVKFTEELLRETKGSVQEPTQPTSCVGMPAEA

SEQ ID NO: 16989 - protein, 99 aa, Homo sapiens; identical to SEQ ID NO: 16988
  Payload ID: 3397
  Gene Symbol: C8orf74
  Gene Name: chromosome 8 open reading frame 74
  ENSP ID: ENSP00000432993

SEQ ID NO: 16990 - protein, 380 aa, Homo sapiens
  Payload ID: 3398
  Gene Symbol: C8orf76
  Gene Name: chromosome 8 open reading frame 76
  Uniprot ID: Q96K31
  ENSP ID: ENSP00000276704
MDSGCWLFGGEFEDSVFEERPERRSGPPASYCAKLCEPQWFYEETESSDDVEVLTLKKFKGDLAYRRQEYQKALQEYSSISEKLSSTNFAMKRDVQEGQARCLAHLGRHMEALEIAANLENKATNTDHLTTVLYLQLAICSSLQNLEKTIFCLQKLISLHPFNPWNWGKLAEAYLNLGPALSAALASSQKQHSFTSSDKTIKSFFPHSGKDCLLCFPETLPESSLFSVEANSSNSQKNEKALTNIQNCMAEKRETVLIETQLKACASFIRTRLLLQFTQPQQTSFALERNLRTQQEIEDKMKGFSFKEDTLLLIAEVMGEDIPEKIKDEVHPEVKCVGSVALTALVTVSSEEFEDKWFRKIKDHFCPFENQFHTEIQILA

SEQ ID NO: 16991 - protein, 86 aa, Homo sapiens
  Payload ID: 3399
  Gene Symbol: C8orf82
  Gene Name: chromosome 8 open reading frame 82
  ENSP ID: ENSP00000316262
MWPPCGTLRTLALARSRGARACSGDGGVSYTQGQSPEPRTREYFYYVDHQGQLFLDDSKMKNFITCFKGNAVPPSPAPSFSLPGSP

SEQ ID NO: 16992 - protein, 216 aa, Homo sapiens
  Payload ID: 3399
  Gene Symbol: C8orf82
  Gene Name: chromosome 8 open reading frame 82
  Uniprot ID: Q6P1X6
  ENSP ID: ENSP00000434593
MWPPCGTLRTLALARSRGARACSGDGGVSYTQGQSPEPRTREYFYYVDHQGQLFLDDSKMKNFITCFKDPQFLVTFFSRLRPNRSGRYEAAFPFLSPCGRERNFLRCEDRPVVFTHLLTADHGPPRLSYCGGGEALAVPFEPARLLPLAANGRLYHPAPERAGGVGLVRSALAFELSACFEYGPGAPALPSHVRWQGRRLALTMDLAPLLLAARSP

SEQ ID NO: 16993 - protein, 134 aa, Homo sapiens
  Payload ID: 3399
  Gene Symbol: C8orf82
  Gene Name: chromosome 8 open reading frame 82
  ENSP ID: ENSP00000436060
  MOD_RES (1)..(1): Any amino acid
XPREREERRARVAEAGAAGTRSAGLLRAGASSRSTAPGVTCWSLPAREENVAALRDAPDPGLGAVAGSPGLQRGWGRFLHAGPESGAADPRVFLLRGPPGPVPSPGADFSPLPGRHPGRPAFFWKPCQKAAACP

SEQ ID NO: 16994 - protein, 216 aa, Homo sapiens; identical to SEQ ID NO: 16992
  Payload ID: 3399
  Gene Symbol: C8orf82
  Gene Name: chromosome 8 open reading frame 82
  Uniprot ID: Q6P1X6
  ENSP ID: ENSP00000436621

SEQ ID NO: 16995 - protein, 261 aa, Homo sapiens
  Payload ID: 3399
  Gene Symbol: C8orf82
  Gene Name: chromosome 8 open reading frame 82
  ENSP ID: ENSP00000437092
  MOD_RES (1)..(1): Any amino acid
XGELGRSGPRLLHGPRPCCVVQLRTLSYKSPAPALTSRRCQGDTRAALPFFGSPVKRQLHVREAAGQVVSAEEVVQLITNLKRGKRCGKELADQGAELFLDDSKMKNFITCFKDPQFLVTFFSRLRPNRSGRYEAAFPFLSPCGRERNFLRCEDRPVVFTHLLTADHGPPRLSYCGGGEALAVPFEPARLLPLAANGRLYHPAPERAGGVGLVRSALAFELSACFEYGPGAPALPSHVRWQGRRLALTMDLAPLLLAARSP

SEQ ID NO: 16996 - protein, 223 aa, Homo sapiens
  Payload ID: 3400
  Gene Symbol: C8orf86
  Gene Name: chromosome 8 open reading frame 86
  Uniprot ID: Q6ZUL3
  ENSP ID: ENSP00000350856
MRPLGKGLLPAEELIRSNLGVGRSLRDCLSQSGKLAEELGSKRLKPAKFGTEGKERVEQRTERQRTGSSKEPRMQIICRRRWREPPPRLLWGCLMPRAQPLLHVTAYENTGHWERLASVVSSKTQQPTVISHSSISITFSHYPPATLDSFLVLEPIKLFPVSSLRSPLCLNCGSCRESIRISGELIGNAHSPAPPRTPELETLGWDKQAVLSGAQVILVCAEV

SEQ ID NO: 16997 - protein, 140 aa, Homo sapiens
  Payload ID: 3400
  Gene Symbol: C8orf86
  Gene Name: chromosome 8 open reading frame 86
  Uniprot ID: Q6ZUL3
  ENSP ID: ENSP00000389615
MRPLGKGLLPAEELIRSNLGVGRSLRDCLSQSGKLAEELGSKRLKPAKFGTEGKERVEQRTERQRTGSSKEPRMQIICRRRWREPPPRLLWGCLMPRAQPLLHVTPPQSSLLELWLLQRKHQNLRGTDWKCTFSSPAQNS

SEQ ID NO: 16998 - protein, 117 aa, Homo sapiens
  Payload ID: 3401
  Gene Symbol: C8orf88
  Gene Name: chromosome 8 open reading frame 88
  Uniprot ID: P0DMB2
  ENSP ID: ENSP00000454561
METKKLIGKPLQPARPVRHLTSPPGAVFPFNFQNEYPCNTQCIQSGVSRCKTNGMQAFSQGLNEQQQQQSPVKKERIKYSRDFLLKLSSVSICRKKPDFLPDHPIVLQKPENNQSFK

SEQ ID NO: 16999 - protein, 75 aa, Homo sapiens
  Payload ID: 3402
  Gene Symbol: C8orf89
  Gene Name: chromosome 8 open reading frame 89
  ENSP ID: ENSP00000478788
MSVLSPEIKCETSKFTRSSFGSCLIFESSWKKAVLETQKIKKEYTTAFGLEELKECIKMPYLPGLQSCQKSAKED

SEQ ID NO: 17000 - protein, 98 aa, Homo sapiens
  Payload ID: 3402
  Gene Symbol: C8orf89
  Gene Name: chromosome 8 open reading frame 89
  ENSP ID: ENSP00000485199
MSVLSPEIKCETSKFTRSSFGSCLIFESSWKKAVLETQKIKKEYTTAFGLEELKECIKMPYLPGLQSCQKSVSSTPLEVPKRLPRADAEVSAVRFWLQ

SEQ ID NO: 17001 - protein, 161 aa, Homo sapiens
  Payload ID: 3402
  Gene Symbol: C8orf89
  Gene Name: chromosome 8 open reading frame 89
  Uniprot ID: P0DMQ9
  ENSP ID: ENSP00000485524
MSVLSPEIKCETSKFTRSSFGSCLIFESSWKKAVLETQKIKKEYTTAFGLEELKECIKMPYLPGLQSCQKSVSSTPLEVPKRLPRADAEVSAVRLKKTKETCSVAPLWEKSKGSGFSDPLTGAPSQYLERLSKIAILEYDTIRQETTTKSKKSKKRDLRDR

SEQ ID NO: 17002 - protein, 376 aa, Homo sapiens
  Payload ID: 3403
  Gene Symbol: C9orf114
  Gene Name: chromosome 9 open reading frame 114
  Uniprot ID: Q5T280
  ENSP ID: ENSP00000354812
MAERGRKRPCGPGEHGQRIEWRKWKQQKKEEKKKWKDLKLMKKLERQRAQEEQAKRLEEEEAAAEKEDRGRPYTLSVALPGSILDNAQSPELRTYLAGQIARACAIFCVDEIVVFDEEGQDAKTVEGEFTGVGKKGQACVQLARILQYLECPQYLRKAFFPKHQDLQFAGLLNPLDSPHHMRQDEESEFREGIVVDRPTRPGHGSFVNCGMKKEVKIDKNLEPGLRVTVRLNQQQHPDCKTYHGKVVSSQDPRTKAGLYWGYTVRLASCLSAVFAEAPFQDGYDLTIGTSERGSDVASAQLPNFRHALVVFGGLQGLEAGADADPNLEVAEPSVLFDLYVNTCPGQGSRTIRTEEAILISLAALQPGLIQAGARHT

SEQ ID NO: 17003 - protein, 87 aa, Homo sapiens
  Payload ID: 3403
  Gene Symbol: C9orf114
  Gene Name: chromosome 9 open reading frame 114
  ENSP ID: ENSP00000473640
TKAGLYWGYTVRLASCLSAVFAEAPFQDGYDLTIGTSERGSDVASAQLPNFRKPSSSPWPPCSLASSRRVPGTPESSKGPRTSVKQQ

SEQ ID NO: 17004 - protein, 388 aa, Homo sapiens
  Payload ID: 3403
  Gene Symbol: C9orf114
  Gene Name: chromosome 9 open reading frame 114
  ENSP ID: ENSP00000481659
MAERGRKRPCGPGEHGQRIEWRKWKQQKKEEKKKWKDLKLMKKLERQRAQEEQAKRLEEEEAAAEKEDRGRPYTLSVALPGSILTMLSRRSFAPTWPVRLPEPVPSSVWMRSWCLMRRARMPRLWRGNSQELEEGAGVRTAGPDPAVPECPQYLRKAFFPKHQDLQFAGLLNPLDSPHHMRQDEESEFREGIVVDRPTRPGHGSFVNCGMKKEVKIDKNLEPGLRVTVRLNQQQHPDCKTYHGKVVSSQDPRTKAGLYWGYTVRLASCLSAVFAEAPFQDGYDLTIGTSERGSDVASASFPTSGMLLWCSGASRVWKLERMLTPTWRWLNPVSSLTCTSIPVLARVAVPSARRKPSSSPWPPCSLASSRRVPGTPESSKGPRTSVKQQ

SEQ ID NO: 17005 - protein, 92 aa, Homo sapiens
  Payload ID: 3404
  Gene Symbol: C9orf116
  Gene Name: chromosome 9 open reading frame 116
  Uniprot ID: Q5BN46
  ENSP ID: ENSP00000360854
MAEECPRACAEPVAPKATAPPERTSDYYRVSADLPGRFNNPGWFRGYRTQKAVSVYRTSNQAYGSRAPTVHEMPRVECSGTILSMFTWRKAS

SEQ ID NO: 17006 - protein, 92 aa, Homo sapiens; identical to SEQ ID NO: 17005
  Payload ID: 3404
  Gene Symbol: C9orf116
  Gene Name: chromosome 9 open reading frame 116
  Uniprot ID: Q5BN46
  ENSP ID: ENSP00000360856

SEQ ID NO: 17007 - protein, 136 aa, Homo sapiens
  Payload ID: 3404
  Gene Symbol: C9orf116
  Gene Name: chromosome 9 open reading frame 116
  Uniprot ID: Q5BN46
  ENSP ID: ENSP00000395281
MAEECPRACAEPVAPKATAPPERTSDYYRVSADLPGRFNNPGWFRGYRTQKAVSVYRTSNQAYGSRAPTVHEMPKVFYPNSNKFSQQLAAGGMFRNNTLNVYLEKSIVTGPDNCITSCDRLNFHPSYNINRPSICD

SEQ ID NO: 17008 - protein, 70 aa, Homo sapiens
  Payload ID: 3404
  Gene Symbol: C9orf116
  Gene Name: chromosome 9 open reading frame 116
  ENSP ID: ENSP00000396392
  MOD_RES (1)..(1): Any amino acid
XIRAVGGRAVGGESPVVVSAPLICVGTQKAVSVYRTSNQAYGSRAPTVHEMPRVECSGTILSMFTWRKAS

SEQ ID NO: 17009 - protein, 196 aa, Homo sapiens
  Payload ID: 3405
  Gene Symbol: C9orf129
  Gene Name: chromosome 9 open reading frame 129
  Uniprot ID: Q5T035
  ENSP ID: ENSP00000364568
MPGMVPPHVPPQMLNIPQTSLQAKPVAPQVPSPGGAPGQGPYPYSLSEPAPLTLDTSGKNLTEQNSYSNIPHEGKHTPLYERSLPINPAQSGSPNHVDSAYFPGSSTSSSSDNDEGSGGATKYTIYWGFRATDHHVQGRDSQARGTAAHWHGGHVCSPNVFWRISHGPAQQLTFPTEQAAPPVCPAPASRRLSAPG

SEQ ID NO: 17010 - protein, 1079 aa, Homo sapiens
  Payload ID: 3406
  Gene Symbol: C9orf131
  Gene Name: chromosome 9 open reading frame 131
  Uniprot ID: Q5VYM1
  ENSP ID: ENSP00000308279
MEWLLEDLLGAKGDMGLLWGQLTHALACRHCGSSCFQSPGNLVTLFLFVVWQIQRWWQLGRLRQLHPWCSGNMVQGKELPLLHRVAFLDHLCKQKSEVEEEGEEEEEGEDEASLDPLKPCSPTKEAPTGEQATPAPPQPSCGSEGLLKAIGIPEQTVMQPVSPSRSFPIFQILTSFPVRHKIASGNRQQQRKSQLFWGLPSLHSESLEAIFLSSGGPSPLKWSVCSSVFFNKLAFLPRSNLLLPQYHSSAQFSTHGAHTMEDLEGMAPDPQLLPPPSSPSVSSLLLHLRPFPVDHKGVLSGAEAPTQSPGTSPLEVLPGYETHLETTGHKKMPQAFEPPMPPPCQSPASLSEPRKVSPEGGLAISKDFWGTVGYREKPQASESSMPVPCPPLDSLPELQRESSLEDPSRYKPQWECRENSGNLWAFESPVLDLNPELSGTSPECVPPASETPWKGMQSRENIWVPADPVSPPSLPSVPLLESLVMGPQGVLSESKALWETMGQKENLWASDSPDPVHSTPPTTLMEPHRINPGECLATSEATWKDTEHSRNSSASRSPSLALSPPPALAPELLRVRSMGVLSDSEARCGDIQKTKNSWASKHPACNLPQDLHGASPLGVLSDSQSIVGEMEQKENCVPVFPGRGSSPSSNSVSKSHVSEPIADQSNYKPDGEAVEQRKNHWATELPAPSSLSTPLPEPHIDLELVWRNVQQREVPQGPSPLAVDPLHPVPQPPTLAEAVKIERTHPGLPKGVTCPGVKAEAPLSQRWTVPELLTHPGIHAWQWSRELKLRLKKLRQSPASRAPGPSQSFCSSPILSSTIPDFWGLPSCPPQQIYPPNPCPHSSSCHPQEVQRTVPQPVQSSHCHHFQSSSQLQPQESGRAEQGSQRGEKMKGKMVSQVPSQGPCVHMEAGVDYLSPGPGEPSNSKVLVSGKRKDKASASSSAKKREHPRKPKAGDHRRGTARLGLSTVTGKNHPAQARSLVEAPVSTFPQRSQHRGQSSQHTALPQLLLPKASGPQDQPEAGRRASDILTPRHCKHCPWAHMEKYLSFPTLKASLTRGLQKVLAKCLDNHRPLPTKSSQ

SEQ ID NO: 17011 - protein, 1006 aa, Homo sapiens
  Payload ID: 3406
  Gene Symbol: C9orf131
  Gene Name: chromosome 9 open reading frame 131
  Uniprot ID: Q5VYM1
  ENSP ID: ENSP00000346472
MLRKELPLLHRVAFLDHLCKQKSEVEEEGEEEEEGEDEASLDPLKPCSPTKEAPTGEQATPAPPQPSCGSEGLLKAIGIPEQTVMQPVSPSRSFPIFQILTSFPVRHKIASGNRQQQRKSQLFWGLPSLHSESLEAIFLSSGGPSPLKWSVCSSVFFNKLAFLPRSNLLLPQYHSSAQFSTHGAHTMEDLEGMAPDPQLLPPPSSPSVSSLLLHLRPFPVDHKGVLSGAEAPTQSPGTSPLEVLPGYETHLETTGHKKMPQAFEPPMPPPCQSPASLSEPRKVSPEGGLAISKDFWGTVGYREKPQASESSMPVPCPPLDSLPELQRESSLEDPSRYKPQWECRENSGNLWAFESPVLDLNPELSGTSPECVPPASETPWKGMQSRENIWVPADPVSPPSLPSVPLLESLVMGPQGVLSESKALWETMGQKENLWASDSPDPVHSTPPTTLMEPHRINPGECLATSEATWKDTEHSRNSSASRSPSLALSPPPALAPELLRVRSMGVLSDSEARCGDIQKTKNSWASKHPACNLPQDLHGASPLGVLSDSQSIVGEMEQKENCVPVFPGRGSSPSSNSVSKSHVSEPIADQSNYKPDGEAVEQRKNHWATELPAPSSLSTPLPEPHIDLELVWRNVQQREVPQGPSPLAVDPLHPVPQPPTLAEAVKIERTHPGLPKGVTCPGVKAEAPLSQRWTVPELLTHPGIHAWQWSRELKLRLKKLRQSPASRAPGPSQSFCSSPILSSTIPDFWGLPSCPPQQIYPPNPCPHSSSCHPQEVQRTVPQPVQSSHCHHFQSSSQLQPQESGRAEQGSQRGEKMKGKMVSQVPSQGPCVHMEAGVDYLSPGPGEPSNSKVLVSGKRKDKASASSSAKKREHPRKPKAGDHRRGTARLGLSTVTGKNHPAQARSLVEAPVSTFPQRSQHRGQSSQHTALPQLLLPKASGPQDQPEAGRRASDILTPRHCKHCPWAHMEKYLSFPTLKASLTRGLQKVLAKCLDNHRPLPTKSSQ

SEQ ID NO: 17012 - protein, 256 aa, Homo sapiens
  Payload ID: 3406
  Gene Symbol: C9orf131
  Gene Name: chromosome 9 open reading frame 131
  ENSP ID: ENSP00000368019
MEWLLEDLLGAKGDMGLLWGQLTHALACRHCGSSCFQSPGNLELPLLHRVAFLDHLCKQKSEVEEEGEEEEEGEDEASLDPLKPCSPTKEAPTGEQATPAPPQPSCGSEGLLKAIGIPEQTVMQPVSPSRSFPIFQILTSFPVRHKIASGNRQQQRKSQLFWGLPSLHSESLEAIFLSSGGPSPLKWSVCSSVFFNKLAFLPRSNLLLPQYHSSAQFSTHGAHTMEDLEGMAPDPQLLPPPSSPSVSSLLLHLRPF

SEQ ID NO: 17013 - protein, 1031 aa, Homo sapiens
  Payload ID: 3406
  Gene Symbol: C9orf131
  Gene Name: chromosome 9 open reading frame 131
  Uniprot ID: Q5VYM1
  ENSP ID: ENSP00000393683
MLRKIQRWWQLGRLRQLHPWCSGNMVQGKELPLLHRVAFLDHLCKQKSEVEEEGEEEEEGEDEASLDPLKPCSPTKEAPTGEQATPAPPQPSCGSEGLLKAIGIPEQTVMQPVSPSRSFPIFQILTSFPVRHKIASGNRQQQRKSQLFWGLPSLHSESLEAIFLSSGGPSPLKWSVCSSVFFNKLAFLPRSNLLLPQYHSSAQFSTHGAHTMEDLEGMAPDPQLLPPPSSPSVSSLLLHLRPFPVDHKGVLSGAEAPTQSPGTSPLEVLPGYETHLETTGHKKMPQAFEPPMPPPCQSPASLSEPRKVSPEGGLAISKDFWGTVGYREKPQASESSMPVPCPPLDSLPELQRESSLEDPSRYKPQWECRENSGNLWAFESPVLDLNPELSGTSPECVPPASETPWKGMQSRENIWVPADPVSPPSLPSVPLLESLVMGPQGVLSESKALWETMGQKENLWASDSPDPVHSTPPTTLMEPHRINPGECLATSEATWKDTEHSRNSSASRSPSLALSPPPALAPELLRVRSMGVLSDSEARCGDIQKTKNSWASKHPACNLPQDLHGASPLGVLSDSQSIVGEMEQKENCVPVFPGRGSSPSSNSVSKSHVSEPIADQSNYKPDGEAVEQRKNHWATELPAPSSLSTPLPEPHIDLELVWRNVQQREVPQGPSPLAVDPLHPVPQPPTLAEAVKIERTHPGLPKGVTCPGVKAEAPLSQRWTVPELLTHPGIHAWQWSRELKLRLKKLRQSPASRAPGPSQSFCSSPILSSTIPDFWGLPSCPPQQIYPPNPCPHSSSCHPQEVQRTVPQPVQSSHCHHFQSSSQLQPQESGRAEQGSQRGEKMKGKMVSQVPSQGPCVHMEAGVDYLSPGPGEPSNSKVLVSGKRKDKASASSSAKKREHPRKPKAGDHRRGTARLGLSTVTGKNHPAQARSLVEAPVSTFPQRSQHRGQSSQHTALPQLLLPKASGPQDQPEAGRRASDILTPRHCKHCPWAHMEKYLSFPTLKASLTRGLQKVLAKCLDNHRPLPTKSSQ

SEQ ID NO: 17014 - protein, 9 aa, Homo sapiens
  Payload ID: 3406
  Gene Symbol: C9orf131
  Gene Name: chromosome 9 open reading frame 131
  ENSP ID: ENSP00000412967
  MOD_RES (1)..(1): Any amino acid
XVQGKVGDL

SEQ ID NO: 17015 - protein, 14 aa, Homo sapiens
  Payload ID: 3406
  Gene Symbol: C9orf131
  Gene Name: chromosome 9 open reading frame 131
  ENSP ID: ENSP00000444996
MVQGKELPLLHRVA

SEQ ID NO: 17016 - protein, 13 aa, Homo sapiens
  Payload ID: 3406
  Gene Symbol: C9orf131
  Gene Name: chromosome 9 open reading frame 131
  ENSP ID: ENSP00000445600
MQPVSPSRSFPIF

SEQ ID NO: 17017 - protein, 229 aa, Homo sapiens
  Payload ID: 3407
  Gene Symbol: C9orf135
  Gene Name: chromosome 9 open reading frame 135
  Uniprot ID: Q5VTT2
  ENSP ID: ENSP00000366402
MDSLDRSCQDWCDRKQHWLEIGPPDLVERKGSLTLRSHHKKYSKPVLVYSWHRDREAFPKGYDIEGPEKVKKLCNSTYRRLGTDESPIWTSETHEKLSQMCLNTEWVEMKSKALLNEETVSSGIIERVTGLPATGFGAVFPRHPPDWSKMCALTTYSEDYVPPYDYQPHAYPCQDDYSIVHRKCRSQFTDLNGSKRFGINTWHDESGIYANSDVKQKLYPLTSGPIVPI

SEQ ID NO: 17018 - protein, 159 aa, Homo sapiens
  Payload ID: 3407
  Gene Symbol: C9orf135
  Gene Name: chromosome 9 open reading frame 135
  Uniprot ID: Q5VTT2
  ENSP ID: ENSP00000431855
MDSLDRSCQDWCDRKQHWLEIGPPDLVERKGSLTLRSHHKKYSKPVLVYSWHRDREAFPKGYDIEGPEKVKKLCNSTYRRLGTDESPIWTSETHEKLSQMCLNTEWVEMKSKALLNEETVSSGIIERVTGLPATGFGAVFPRHPPDWSKMLIPVKMIIP

SEQ ID NO: 17019 - protein, 149 aa, Homo sapiens
  Payload ID: 3407
  Gene Symbol: C9orf135
  Gene Name: chromosome 9 open reading frame 135
  ENSP ID: ENSP00000433123
  MOD_RES (1)..(1): Any amino acid
XERKGSLTLRSHHKKYSKPVLVYSWHRDREAFPKGYDIEGPEKVKKLCNSTYRRLGTDESPIWTSETHEKLSQMCLNTEWVEMKSKALLNEETVSSGIIERVTGLPATGFGAVFPRHPPDWSKMLVVPKLLQLYKMFLDSEGLFAGAKV

SEQ ID NO: 17020 - protein, 37 aa, Homo sapiens
  Payload ID: 3407
  Gene Symbol: C9orf135
  Gene Name: chromosome 9 open reading frame 135
  ENSP ID: ENSP00000433973
  MOD_RES (1)..(1): Any amino acid
XKQHWLEIGPPDLVERKGSLTLRSHHKKYSKPVLVYS

SEQ ID NO: 17021 - protein, 50 aa, Homo sapiens
  Payload ID: 3407
  Gene Symbol: C9orf135
  Gene Name: chromosome 9 open reading frame 135
  ENSP ID: ENSP00000434032
MDSLDRSCQDWCDRKQHWLEIGPPDLVERKGSLTLRSHHKKYSKPVLVYS

SEQ ID NO: 17022 - protein, 50 aa, Homo sapiens; identical to SEQ ID NO: 17021
  Payload ID: 3407
  Gene Symbol: C9orf135
  Gene Name: chromosome 9 open reading frame 135
  ENSP ID: ENSP00000436701

SEQ ID NO: 17023 - protein, 204 aa, Homo sapiens
  Payload ID: 3408
  Gene Symbol: C9orf142
  Gene Name: chromosome 9 open reading frame 142
  Uniprot ID: Q9BUH6
  ENSP ID: ENSP00000360682
MDPLSPPLCTLPPGPEPPRFVCYCEGEESGEGDRGGFNLYVTDAAELWSTCFTPDSLAALKARFGLSAAEDITPRFRAACEQQAVALTLQEDRASLTLSGGPSALAFDLSKVPGPEAAPRLRALTLGLAKRVWSLERRLAAAEETAVSPRKSPRPAGPQLFLPDPDPQRGGPGPGVRRRCPGESLINPGFKSKKPAGGVDFDET

SEQ ID NO: 17024 - protein, 239 aa, Homo sapiens
  Payload ID: 3409
  Gene Symbol: C9orf152
  Gene Name: chromosome 9 open reading frame 152
  Uniprot ID: Q5JTZ5
  ENSP ID: ENSP00000383456
MEGLPCPCPALPHFWQLRSHLMAEGSRTQAPGKGPPLSIQFLRAQYEGLKRQQRTQAHLLVLPKGGNTPAPAESMVNAVWINKERRSSLSLEEADSEVEGRLEEAAQGCLQAPKSPWHTHLEMHCLVQTSPQDTSHQVHHRGKLVGSDQRLPPEGDTHLFETNQMTQQGTGIPEAAQLPCQVGNTQTKAVESGLKFSTQCPLSIKNPHRSGKPAYYPFPQRKTPRISQAARNLGLYGSA

SEQ ID NO: 17025 - protein, 95 aa, Homo sapiens
  Payload ID: 3410
  Gene Symbol: C9orf153
  Gene Name: chromosome 9 open reading frame 153
  Uniprot ID: Q5TBE3
  ENSP ID: ENSP00000344865
MFLTGDTSPAEDNREATLPQCSLPELYACIENFNKESKKSNLLKMHGISLNEAQEVLARNLNVMSFTRGADVRGDLQPVIRKTIHESKGSGMEIF

SEQ ID NO: 17026 - protein, 101 aa, Homo sapiens
  Payload ID: 3410
  Gene Symbol: C9orf153
  Gene Name: chromosome 9 open reading frame 153
  Uniprot ID: Q5TBE3
  ENSP ID: ENSP00000365169
MFLTGDTSPAEDNREATLPQCSLPELYACIENFNKESKKSNLLKMHGISLNEAQEVLARNLNVMSFTRGADVRGDLQPVISVNKMNKPGKHRKTPSPKINK

SEQ ID NO: 17027 - protein, 95 aa, Homo sapiens; identical to SEQ ID NO: 17025
  Payload ID: 3410
  Gene Symbol: C9orf153
  Gene Name: chromosome 9 open reading frame 153
  Uniprot ID: Q5TBE3
  ENSP ID: ENSP00000484453

SEQ ID NO: 17028 - protein, 101 aa, Homo sapiens; identical to SEQ ID NO: 17026
  Payload ID: 3410
  Gene Symbol: C9orf153
  Gene Name: chromosome 9 open reading frame 153
  Uniprot ID: Q5TBE3
  ENSP ID: ENSP00000484765

SEQ ID NO: 17029 - protein, 83 aa, Homo sapiens
  Payload ID: 3411
  Gene Symbol: C9orf16
  Gene Name: chromosome 9 open reading frame 16
  Uniprot ID: Q9BUW7
  ENSP ID: ENSP00000362085
MSGPNGDLGMPVEAGAEGEEDGFGEAEYAAINSMLDQINSCLDHLEEKNDHLHARLQELLESNRQTRLEFQQQLGEAPSDASP

SEQ ID NO: 17030 - protein, 976 aa, Homo sapiens
  Payload ID: 3412
  Gene Symbol: C9orf172
  Gene Name: chromosome 9 open reading frame 172
  Uniprot ID: C9J069
  ENSP ID: ENSP00000412388
MTRTDPPDLLVSTVYQDIKVATPGPASKCSPCERSVARPAEPAPFNKRHCRSFDFLEALDGPAMETLPEPPPPESAVPRARTREAEPRRRARSKSAPRAPPGLTPAPASPPVLPRRGREAQRAARAEASPRREPAYPALRALANELHPIKLQPQRGGPGRVAPLCAAAGRCAPPEPPAGPAPHVRCRLDIKPDDAVLQHATRGSRSCGPTEAAHWARPAPQFHGLTVPGPRHMALSRTPTPSDSYCADPRAFYCDGPLPGPRDYAERRSLPFTTPPGPTQFFYTEEPQGFRGSFAASPGPTFDAYYPRPYPSEELSGPSPRRMGGYYAGEVRTFPIQEPPSRSYYGEAPRAYGLPYGPRYVPEEPRAHSTARPFYTEDFGRYRERDVLARTYPHPRSSPAWADWGPRPYRTLQVVPPSDPDPLLASWHGGTGTSPPRLATDSRHYSRSWDNILAPGPRREDPLGRGRSYENLLGREVREPRGVSPEGRRPPVVVNLSTSPRRYAALSLSETSLTEKGRAGEGLGRNWYVTPEITITDNDLRATERPSARAWELPGGRTRPPPHAAPDGPTSGRQRSLEQLDELITDLVIDSRPTAGQASEPAADCLGPQLRRLLDSRPAGSGAPALAPPRSPPASAGSAEEPAAPGEAADASPEPSADEDDLMTCSNARCRRTETMFNACLYFKSCHSCYTYYCSRLCRREDWDAHKARCVYGRVGSVCRHVLQFCRDSGPVHRAFSRIARVGFLSRGRGVLFLGFPSPGSADNFLRFGLEGLLLSPTYLSLRELATHAAPLGSYARELAAAGRLYEPAECFLLSVSVAVGPGTAPPGTPALPAPAPRSHGPTVRKFAKVALAAGSPARPPPARSREPDMETLILTPPPGTAGLDQDGEAGRRAREVAFIHIQRELRLRGVFLRHEFPRVYEQLCEFVEANRRFTPTTIYPTDRRTGRPFMCMIMAASEPRALDWVASANLLDDIM

SEQ ID NO: 17031 - protein, 386 aa, Homo sapiens
  Payload ID: 3413
  Gene Symbol: C9orf173
  Gene Name: chromosome 9 open reading frame 173
  Uniprot ID: Q8N7X2
  ENSP ID: ENSP00000373583
MMNSDQKAVKFLANFYINGGKHWTHGHLRQTQPEPTQPKASVLLLGPEPGMAWDETQPPKMKEIPVGLRLQTGTPQESLPTYTQTLRELLLEQRPLITADLEVPSPTRYQVPSPSVRESSPHPHYSIGCKHQGREGGGRRAWQTLWFQSESPFTQKADFDQEQKWPSPAHYQLLSRPAFPAFSFRGCHSASKTPEGHTHLGLPGARGLGLRVQPQSLLQASLQAPGKRCPGPNTYNILPGSRLQSPRSPAFSMSRSPAFTSWLSTSFSFGSPNPWPSRLPRGGLQLTLPFGAWRGHPGCTQTQAPRHRPLLHALEPAGHNLLGPATEWNHGLPRGFPRPPLGLGAPAWPSDPLGTPMHPSGWPTLLWAVDKAGPAWIPHLPISPLH

SEQ ID NO: 17032 - protein, 308 aa, Homo sapiens
  Payload ID: 3413
  Gene Symbol: C9orf173
  Gene Name: chromosome 9 open reading frame 173
  Uniprot ID: Q8N7X2
  ENSP ID: ENSP00000391218
MMNSDQKAVKFLANFYINGGKHWTHGHLRQTQPEPTQPKASVLLLGPEPGMAWDETQPPKMKEIPVGLRLQTGTPQESLPTYTQTLRELLLEQRPLITADLEVPSPTRYQVPSPSVRESSPHPHYSIGCKHQGREGGGRRAWQTLWFQSESPFTQKADFDQEQKWPSPAHYQLLSRPAFPAFSFRGCHSASKTPEGHTHLGLPGARGLGLRVQPQSLLQASLQAPGKRCPGPNTYNILPGSRLQSPRSPAFSMSRSPAFTSWLSTSRTPGPAAYHVEDCNSRFPSAPGVVIQGVRRPKRHDTGPFCTL

SEQ ID NO: 17033 - protein, 331 aa, Homo sapiens
  Payload ID: 3413
  Gene Symbol: C9orf173
  Gene Name: chromosome 9 open reading frame 173
  Uniprot ID: Q8N7X2
  ENSP ID: ENSP00000477998
MMNSDQKAVKFLANFYINGGKHWTHGHLRQTQPEPTQPKASVLLLGPEPGMAWDETQPPKMKEIPVGLRLQTGTPQESLPTYTQTLRELLLEQRPLITADLEVPSPTRYQVPSPSVRESSPHPHYSIGCKHQGREGGGRRAWQTLWFQSESPFTQKADFDQEQKASLQAPGKRCPGPNTYNILPGSRLQSPRSPAFSMSRSPAFTSWLSTSFSFGSPNPWPSRLPRGGLQLTLPFGAWRGHPGCTQTQAPRHRPLLHALEPAGHNLLGPATEWNHGLPRGFPRPPLGLGAPAWPSDPLGTPMHPSGWPTLLWAVDKAGPAWIPHLPISPLH

SEQ ID NO: 17034 - protein, 83 aa, Homo sapiens
  Payload ID: 3413
  Gene Symbol: C9orf173
  Gene Name: chromosome 9 open reading frame 173
  ENSP ID: ENSP00000478004
KAVKFLANFYINGGKHWTHGHLRQTQPEPTQPKASVLLLGPEPGMAWDETQPPKMKEIPVGLRLQTGTPQESLPTYTQTLREL

SEQ ID NO: 17035 - protein, 253 aa, Homo sapiens
  Payload ID: 3413
  Gene Symbol: C9orf173
  Gene Name: chromosome 9 open reading frame 173
  ENSP ID: ENSP00000482144
MMNSDQKAVKFLANFYINGGKHWTHGHLRQTQPEPTQPKASVLLLGPEPGMAWDETQPPKMKEIPVGLRLQTGTPQESLPTYTQTLRELLLEQRPLITADLEVPSPTRYQVPSPSVRESSPHPHYSIGCKHQGREGGGRRAWQTLWFQSESPFTQKADFDQEQKASLQAPGKRCPGPNTYNILPGSRLQSPRSPAFSMSRSPAFTSWLSTSRTPGPAAYHVEDCNSRFPSAPGVVIQGVRRPKRHDTGPFCTL

SEQ ID NO: 17036 - protein, 130 aa, Homo sapiens
  Payload ID: 3413
  Gene Symbol: C9orf173
  Gene Name: chromosome 9 open reading frame 173
  ENSP ID: ENSP00000483862
MMNSDQKAVKFLANFYINGGKHWTHGHLRQTQPEPTQPKASVLLLGPEPGMAWDETQPPKMKEIPVGLRLQTGTPQESLPTYTQTLRELLLEQRPLITADLEVPSPTRGRWPQGMADFVVPERKPLHAES

SEQ ID NO: 17037 - protein, 262 aa, Homo sapiens
  Payload ID: 3414
  Gene Symbol: C9orf24
  Gene Name: chromosome 9 open reading frame 24
  Uniprot ID: Q8NCR6
  ENSP ID: ENSP00000297623
MFLFSRKTRTPISTYSDSYRAPTSIKEVYKDPPLCAWEANKFLTPGLTHTMERHVDPEALQKMAKCAVQDYTYRGSISGHPYLPEKYWLSQEEADKCSPNYLGSDWYNTWRMEPYNSSCCNKYTTYLPRLPKEARMETAVRGMPLECPPRPERLNAYEREVMVNMLNSLSRNQQLPRITPRCGCVDPLPGRLPFHGYESACSGRHYCLRGMDYYASGAPCTDRRLRPWCREQPTMCTSLRAPARNAVCCYNSPAVILPISEP

SEQ ID NO: 17038 - protein, 164 aa, Homo sapiens
  Payload ID: 3414
  Gene Symbol: C9orf24
  Gene Name: chromosome 9 open reading frame 24
  Uniprot ID: Q8NCR6
  ENSP ID: ENSP00000368419
METAVRGMPLECPPRPERLNAYEREVMVNMLNSLSRNQQLPRITPRCGCVDPLPGRLPFHGYESACSGRHYCLRGMDYYASGAPCTDRRLRPWCREQPTVRCVPPYEHRPGMQCAVTTPPPSYYPYPNLRWDTSHFKKSGGPQRNNYVIHPEFVSETYPDYRCW

SEQ ID NO: 17039 - protein, 111 aa, Homo sapiens
  Payload ID: 3414
  Gene Symbol: C9orf24
  Gene Name: chromosome 9 open reading frame 24
  Uniprot ID: Q8NCR6
  ENSP ID: ENSP00000368421
METAVRGMPLECPPRPERLNAYEREVMVNMLNSLSRNQQLPRITPRCGCVPPYEHRPGMQCAVTTPPPSYYPYPNLRWDTSHFKKSGGPQRNNYVIHPEFVSETYPDYRCW

SEQ ID NO: 17040 - protein, 164 aa, Homo sapiens; identical to SEQ ID NO: 17038
  Payload ID: 3414
  Gene Symbol: C9orf24
  Gene Name: chromosome 9 open reading frame 24
  Uniprot ID: Q8NCR6
  ENSP ID: ENSP00000368422

SEQ ID NO: 17041 - protein, 127 aa, Homo sapiens
  Payload ID: 3414
  Gene Symbol: C9orf24
  Gene Name: chromosome 9 open reading frame 24
  Uniprot ID: Q8NCR6
  ENSP ID: ENSP00000368428
METAVRGMPLECPPRPERLNAYEREVMVNMLNSLSRNQQLPRITPRCGCVDPLPGRLPFHGYESACSGRHYCLRGMDYYASGAPCTDRRLRPWCREQPTMCTSLRAPARNAVCCYNSPAVILPISEP

SEQ ID NO: 17042 - protein, 126 aa, Homo sapiens
  Payload ID: 3414
  Gene Symbol: C9orf24
  Gene Name: chromosome 9 open reading frame 24
  ENSP ID: ENSP00000389687
  MOD_RES (1)..(1): Any amino acid
XAWEANKFLTPGLTHTMERHVDPEALQKMAKCAVQDYTYRGSISGHPYLPEKYWLSQEEADKCSPNYLGSDWYNTWRMEPYNSSCCNKYTTYLPRLPKVSVAPSTDVWGLGHAYPTTSQTTVTDIS

SEQ ID NO: 17043 - protein, 566 aa, Homo sapiens
  Payload ID: 3415
  Gene Symbol: C9orf3
  Gene Name: chromosome 9 open reading frame 3
  Uniprot ID: Q8N6M6
  ENSP ID: ENSP00000277198
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMASPHIMFLSQSILTGGNHLCGTRLCHEIAHAWFGLAIGARDWTEEWLSEGFATHLEDVFWATAQQLAPYEAREQQELRACLRWRRLQDEMQCSPEEMQVLRFPHVGGCSGSFS

SEQ ID NO: 17044 - protein, 720 aa, Homo sapiens
  Payload ID: 3415
  Gene Symbol: C9orf3
  Gene Name: chromosome 9 open reading frame 3
  Uniprot ID: Q8N6M6
  ENSP ID: ENSP00000297979
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMARPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 17045 - protein, 819 aa, Homo sapiens
  Payload ID: 3415
  Gene Symbol: C9orf3
  Gene Name: chromosome 9 open reading frame 3
  Uniprot ID: Q8N6M6
  ENSP ID: ENSP00000364464
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMASPHIMFLSQSILTGGNHLCGTRLCHEIAHAWFGLAIGARDWTEEWLSEGFATHLEDVFWATAQQLAPYEAREQQELRACLRWRRLQDEMQCSPEEMQVLRPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 17046 - protein, 140 aa, Homo sapiens
  Payload ID: 3415
  Gene Symbol: C9orf3
  Gene Name: chromosome 9 open reading frame 3
  ENSP ID: ENSP00000387736
SSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGR

SEQ ID NO: 17047 - protein, 601 aa, Homo sapiens
  Payload ID: 3415
  Gene Symbol: C9orf3
  Gene Name: chromosome 9 open reading frame 3
  ENSP ID: ENSP00000401854
LFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMASPHIMFLSQSILTGGNHLCGTRLCHEIAHAWFGLAIGARDWTEEWLSEGFATHLEDVFWATAQQLAPYEAREQQELRACLRWRRLQDEMQCSPEEMQVLRPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 17048 - protein, 508 aa, Homo sapiens
  Payload ID: 3415
  Gene Symbol: C9orf3
  Gene Name: chromosome 9 open reading frame 3
  ENSP ID: ENSP00000402171
VVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMARPSKDKTGHTSDSGASVIKHGLNPEKIFMQVHYLKGYFLLRFLAKRLGDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQVGVIFQQMGIL

SEQ ID NO: 17049 - protein, 145 aa, Homo sapiens
  Payload ID: 3415
  Gene Symbol: C9orf3
  Gene Name: chromosome 9 open reading frame 3
  ENSP ID: ENSP00000411451
  MOD_RES (1)..(1): Any amino acid
XDETYFSFLRKFVHTFHGQLILSQDFLQMLLENIPEEKRLELSVENIYQDWLESSGIPKPLQRERRAGAECGLARQVRAEVTKWIGVNRRPRKRKRREKEEVFEKTLNWSHLRNRERRRKKWITFKTLGGILFTVKQMRNLFAQV

SEQ ID NO: 17050 - protein, 184 aa, Homo sapiens
  Payload ID: 3415
  Gene Symbol: C9orf3
  Gene Name: chromosome 9 open reading frame 3
  ENSP ID: ENSP00000413927
  MOD_RES (1)..(1): Any amino acid
XADPGRAQGAGSGAAAASSPAAGEPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 17051 - protein, 180 aa, Homo sapiens
  Payload ID: 3415
  Gene Symbol: C9orf3
  Gene Name: chromosome 9 open reading frame 3
  ENSP ID: ENSP00000431923
  MOD_RES (1)..(1): Any amino acid
XRAQGAGSGAAAASSPAAGEPLQRERRAGAECGLARQVRAEVTKWIGVNRRPRKRKRREKEEVFEKLLPDQLVLLLEHLLEQKTLSPRTLQSLQRTYHLQDQDAEVRHRWCELIVKHKFTKAYKSVERFLQEDQAMGVYLYGELMVSEDARQQQLARRCFERTKEQMDRSSAQVVAEMLF

SEQ ID NO: 17052 - protein, 194 aa, Homo sapiens
  Payload ID: 3416
  Gene Symbol: C9orf40
  Gene Name: chromosome 9 open reading frame 40
  Uniprot ID: Q8IXQ3
  ENSP ID: ENSP00000366050
MAKRRAAEPVTFHVPWKRLLLCDFAEQPPPPPLWIRPPGVAHAGQLLGVPEQHRKRKIDAGTMAEPSASPSKRRDSGDNSAPSGQEREDHGLETGDPPLPPPPVLPGPGEELPGARLPGGGGDDGAGRAGPPRGDWGVASRQHNEEFWQYNTFQYWRNPLPPIDLADIEDLSEDTLTEATLQGRNEGAEVDMES

SEQ ID NO: 17053 - protein, 461 aa, Homo sapiens
  Payload ID: 3417
  Gene Symbol: C9orf43
  Gene Name: chromosome 9 open reading frame 43
  Uniprot ID: Q8TAL5
  ENSP ID: ENSP00000288462
MDLPDESQWDETTCGLAVCQHPQCWATIRRIERGHPRILGSSCKTPLDAEDKLPVLTVVDILDSGFAAHHLPECTFTKAHSLLSQSSKFYSKFHGRPPKGLPDKSLINCTNRLPKFPVLNLNETQLPCPEDVRNMVVLWIPEETEIHVSQHGKKKRKNSAVKSKSFLGLSGNQSAGTRVGTPGMIVPPPTPVQLSEQFSSDFLPLWAQSEALPQDLLKELLPGGKQTMLCPEMKIKLAMMKKNLPLEKNRPDSVISSKMFLSIHRLTLERPALRYPERLKKLHNLKTEGYRKQQQRQQQQQQQQKKVKTPIKKQEAKKKAKSDPGIQSTSHKHPVTTVHDRLYGYRTLPGQNSDMKQQQQMEKGTTSKQDSTERPKMNYYDHADFHHSVKSPELYETEPTNKDISAPVDAVPEAQAARQKKISFNFSEIMASTGWNSELKLLRILQDTDDEDEEDQSSGAE

SEQ ID NO: 17054 - protein, 461 aa, Homo sapiens; identical to SEQ ID NO: 17053
  Payload ID: 3417
  Gene Symbol: C9orf43
  Gene Name: chromosome 9 open reading frame 43
  Uniprot ID: Q8TAL5
  ENSP ID: ENSP00000363280

SEQ ID NO: 17055 - protein, 202 aa, Homo sapiens
  Payload ID: 3418
  Gene Symbol: C9orf47
  Gene Name: chromosome 9 open reading frame 47
  Uniprot ID: Q6ZRZ4
  ENSP ID: ENSP00000335616
MVRIWTTIMIVLILLLRIGPNKPSLSGRQAPAQAQTSDLVPSLFPLGLWAPGFCTWSSPDEDKVWRPAWEQGPKGEPDPRGLRPRKPVPGTGNRDSGTRRRLQDATEQDPRPGNDVASAETAGPPSPSGIRAQDRAPRHRRAPPARMPVAPAPSADGEPLQEQGGGLFHRTRSVYNGLELNTWMKVERLFVEKFHQSFSLDN

SEQ ID NO: 17056 - protein, 235 aa, Homo sapiens
  Payload ID: 3418
  Gene Symbol: C9orf47
  Gene Name: chromosome 9 open reading frame 47
  ENSP ID: ENSP00000365010
MVRIWTTIMIVLILLLRIGPNKPSLSGRQAPAQAQTSDLVPSLFPLGLWAPGFCTWSSPDEDKRPRKPVPGTGNRDSGTRRRLQDATEQDPRPGNDVASAETAGPPSPSGIRAQDRAPRHRRAPPARMPVAPAPSADGGERRARAGRGTRVGGWGPKDPPFQQNPHRSRARRGLGRATAAGALHISTPPPEPLQEQGGGLFHRTRSVYNGLELNTWMKVERLFVEKFHQSFSLDN

SEQ ID NO: 17057 - protein, 183 aa, Homo sapiens
  Payload ID: 3418
  Gene Symbol: C9orf47
  Gene Name: chromosome 9 open reading frame 47
  Uniprot ID: Q6ZRZ4
  ENSP ID: ENSP00000365011
MVRIWTTIMIVLILLLRIGPNKPSLSGRQAPAQAQTSDLVPSLFPLGLWAPGFCTWSSPDEDKRPRKPVPGTGNRDSGTRRRLQDATEQDPRPGNDVASAETAGPPSPSGIRAQDRAPRHRRAPPARMPVAPAPSADGEPLQEQGGGLFHRTRSVYNGLELNTWMKVERLFVEKFHQSFSLDN

SEQ ID NO: 17058 - protein, 431 aa, Homo sapiens
  Payload ID: 3419
  Gene Symbol: C9orf50
  Gene Name: chromosome 9 open reading frame 50
  Uniprot ID: Q5SZB4
  ENSP ID: ENSP00000361556
MFWRRLRPGAQDLAPKGLPGDGDFRRSSDPRLPKLTPPALRAALGARGSGDWRIPGGGAAWWPEGDAKPGVGVGRLPPRLPALLTATRRAVRKRGLLRSLLPPPLLSAGASRESAPRQPGPGERERPRRRVAREDPDFLGAFLGELLPSRFREFLHQLQEKCAEEPEPLTSPAPQHQRGVLEHCPGSPRCPNCSFLPDLWGQSSHLQDSLTKISLQQTPILGPLKGDHSQFTTVRKANHRPHGAQVPRLKAALTHNPSGEGSRPCRQRCPFRVRFADETLQDTTLRYWERRRSVQQSVIVNQKAALPVASERVFGSVGKRLESLPKALYPGAKEETLASSSCWDCAGLSTQKTQGYLSEDTSMNSSLPFCSWKKAAAQRPRSSLRAFLDPHRNLEQESLLPNRVLQSVLKQGCPKGYHLLLASATLQPDKR

SEQ ID NO: 17059 - protein, 69 aa, Homo sapiens
  Payload ID: 3419
  Gene Symbol: C9orf50
  Gene Name: chromosome 9 open reading frame 50
  ENSP ID: ENSP00000480795
MNSSLPFCSWKKAAAQRPRSSLRAFLDPHRNLEQESLLPNRVLQSVLKQGCPKGYHLLLASATLQPDKR

SEQ ID NO: 17060 - protein, 161 aa, Homo sapiens
  Payload ID: 3420
  Gene Symbol: C9orf57
  Gene Name: chromosome 9 open reading frame 57
  Uniprot ID: Q5W0N0
  ENSP ID: ENSP00000366223
MKKIEISGTCLSFHLLFGLEIRMRRIVFAGVILFRLLGVILFRLLGVILFGRLGDLGTCQTKPGQYWKEEVHIQDVGGLICRACNLSLPFHGCLLDLGTCQAEPGQYCKEEVHIQGGIQWYSVKGCTKNTSECFKSTLVKRILQLHELVTTHCCNHSLCNF

SEQ ID NO: 17061 - protein, 127 aa, Homo sapiens
  Payload ID: 3420
  Gene Symbol: C9orf57
  Gene Name: chromosome 9 open reading frame 57
  Uniprot ID: Q5W0N0
  ENSP ID: ENSP00000412956
MGVGFTELEYLAPWLRPPFSDLGTCQTKPGQYWKEEVHIQDVGGLICRACNLSLPFHGCLLDLGTCQAEPGQYCKEEVHIQGGIQWYSVKGCTKNTSECFKSTLVKRILQLHELVTTHCCNHSLCNF

SEQ ID NO: 17062 - protein, 200 aa, Homo sapiens
  Payload ID: 3421
  Gene Symbol: C9orf64
  Gene Name: chromosome 9 open reading frame 64
  ENSP ID: ENSP00000318375
MPLVEERHRILNETGKILLEKFGGSFLNCVRESENSAQKLMHLVVESFPSYRDVTLFEGKRVSFYKRAQILVADTWSVLEGKGDGCFKDISSITMFADYRLPQVLAHLGALKYSDDLLKKLLKGEMLSYGDRQEVEIRGCSLWCVELIRDCLLELIEQKGEKPNGEINSILLDYYLWDYAHDHREDMKGIPFHRIRCIYY

SEQ ID NO: 17063 - protein, 60 aa, Homo sapiens
  Payload ID: 3421
  Gene Symbol: C9orf64
  Gene Name: chromosome 9 open reading frame 64
  ENSP ID: ENSP00000365518
MPLVEERHRILNETGKILLEKFGGSFLNCVRESENSAQKLMHLVVESFPSYRDVTLFECT

SEQ ID NO: 17064 - protein, 341 aa, Homo sapiens
  Payload ID: 3421
  Gene Symbol: C9orf64
  Gene Name: chromosome 9 open reading frame 64
  Uniprot ID: Q5T6V5
  ENSP ID: ENSP00000365522
MDGLLNPRESSKFIAENSRDVFIDSGGVRRVAELLLAKAAGPELRVEGWKALHELNPRAADEAAVNWVFVTDTLNFSFWSEQDEHKCVVRYRGKTYSGYWSLCAAVNRALDEGIPITSASYYATVTLDQVRNILRSDTDVSMPLVEERHRILNETGKILLEKFGGSFLNCVRESENSAQKLMHLVVESFPSYRDVTLFEGKRVSFYKRAQILVADTWSVLEGKGDGCFKDISSITMFADYRLPQVLAHLGALKYSDDLLKKLLKGEMLSYGDRQEVEIRGCSLWCVELIRDCLLELIEQKGEKPNGEINSILLDYYLWDYAHDHREDMKGIPFHRIRCIYY

SEQ ID NO: 17065 - protein, 295 aa, Homo sapiens
  Payload ID: 3422
  Gene Symbol: C9orf66
  Gene Name: chromosome 9 open reading frame 66
  Uniprot ID: Q5T8R8
  ENSP ID: ENSP00000371824
MRHSVARPTRLPRRLSPFWDPATCKNLEGGAGEVVRGRDPRRLRTSRSTEILGEDLAGPSAGAAARPAAPPPQPREPGAPGLRRAPPRTRMDSSGLGPCSEAPLHTSAGLSGRNLRAAGGVLPVDLERERAALCARQSGHGPPAVRWLLGSRGAESGGLARRRVAAEHAQPSANLVCRSALETSAFPPSKPKSPRGRVRARSSDGRLRHPAWRAGSGGRGGRGPSAELASRYWGRRRALPGAADLRPKGARADDRRPLRAGRKLHLPEAARLPGNVGKSGEPHKAGEVGNHPRDS

SEQ ID NO: 17066 - protein, 139 aa, Homo sapiens
  Payload ID: 3423
  Gene Symbol: C9orf69
  Gene Name: chromosome 9 open reading frame 69
  Uniprot ID: H0YL14
  ENSP ID: ENSP00000452750
MPVMPIPRRVRSFHGPHTTCLHAACGPVRASHLARTKYNNFDVYIKTRWLYGFIRFLLYFSCSLFTAALWGALAALFCLQYLGVRVLLRFQRKLSVLLLLLGRRRVDFRLVNELLVYGIHVTMLLVGGLGWCFMVFVDM

SEQ ID NO: 17067 - protein, 139 aa, Homo sapiens; identical to SEQ ID NO: 17066
  Payload ID: 3423
  Gene Symbol: C9orf69
  Gene Name: chromosome 9 open reading frame 69
  Uniprot ID: H0YL14
  ENSP ID: ENSP00000453019

SEQ ID NO: 17068 - protein, 38 aa, Homo sapiens
  Payload ID: 3423
  Gene Symbol: C9orf69
  Gene Name: chromosome 9 open reading frame 69
  ENSP ID: ENSP00000455849
MPVMPIPRRVRSFHGPHTTCLHAACGPVRASHLARTKY

SEQ ID NO: 17069 - protein, 139 aa, Homo sapiens; identical to SEQ ID NO: 17066
  Payload ID: 3423
  Gene Symbol: C9orf69
  Gene Name: chromosome 9 open reading frame 69
  Uniprot ID: H0YL14
  ENSP ID: ENSP00000457272

SEQ ID NO: 17070 - protein, 32 aa, Homo sapiens
  Payload ID: 3423
  Gene Symbol: C9orf69
  Gene Name: chromosome 9 open reading frame 69
  ENSP ID: ENSP00000458020
MPVMPIPRRVRSFHGPHTTCLHAACGPVRASH

SEQ ID NO: 17071 - protein, 222 aa, Homo sapiens
  Payload ID: 3424
  Gene Symbol: C9orf72
  Gene Name: chromosome 9 open reading frame 72
  Uniprot ID: Q96LT7
  ENSP ID: ENSP00000369331
MSTLCPPPSPAVAKTEIALSGKSPLLAATFAYWDNILGPRVRHIWAPKTEQVLLSDGEITFLANHTLNGEILRNAESGAIDVKFFVLSEKGVIIVSLIFDGNWNGDRSTYGLSIILPQTELSFYLPLHRVCVDRLTHIIRKGRIWMHKERQENVQKIILEGTERMEDQGQSIIPMLTGEVIPVMELLSSMKSHSVPEEIDIADTVLNDDDIGDSCHEGFLLK

SEQ ID NO: 17072 - protein, 222 aa, Homo sapiens; identical to SEQ ID NO: 17071
  Payload ID: 3424
  Gene Symbol: C9orf72
  Gene Name: chromosome 9 open reading frame 72
  Uniprot ID: Q96LT7
  ENSP ID: ENSP00000369333

SEQ ID NO: 17073 - protein, 481 aa, Homo sapiens
  Payload ID: 3424
  Gene Symbol: C9orf72
  Gene Name: chromosome 9 open reading frame 72
  Uniprot ID: Q96LT7
  ENSP ID: ENSP00000369339
MSTLCPPPSPAVAKTEIALSGKSPLLAATFAYWDNILGPRVRHIWAPKTEQVLLSDGEITFLANHTLNGEILRNAESGAIDVKFFVLSEKGVIIVSLIFDGNWNGDRSTYGLSIILPQTELSFYLPLHRVCVDRLTHIIRKGRIWMHKERQENVQKIILEGTERMEDQGQSIIPMLTGEVIPVMELLSSMKSHSVPEEIDIADTVLNDDDIGDSCHEGFLLNAISSHLQTCGCSVVVGSSAEKVNKIVRTLCLFLTPAERKCSRLCEAESSFKYESGLFVQGLLKDSTGSFVLPFRQVMYAPYPTTHIDVDVNTVKQMPPCHEHIYNQRRYMRSELTAFWRATSEEDMAQDTIIYTDESFTPDLNIFQDVLHRDTLVKAFLDQVFQLKPGLSLRSTFLAQFLLVLHRKALTLIKYIEDDTQKGKKPFKSLRNLKIDLDLTAEGDLNIIMALAEKIKPGLHSFIFGRPFYTSVQERDVLMTF

SEQ ID NO: 17074 - protein, 481 aa, Homo sapiens; identical to SEQ ID NO: 17073
  Payload ID: 3424
  Gene Symbol: C9orf72
  Gene Name: chromosome 9 open reading frame 72
  Uniprot ID: Q96LT7
  ENSP ID: ENSP00000482753

SEQ ID NO: 17075 - protein, 289 aa, Homo sapiens
  Payload ID: 3425
  Gene Symbol: C9orf78
  Gene Name: chromosome 9 open reading frame 78
  Uniprot ID: Q9NZ63
  ENSP ID: ENSP00000361524
MPVVRKIFRRRRGDSESEEDEQDSEEVRLKLEETREVQNLRKRPNGVSAVALLVGEKVQEETTLVDDPFQMKTGGMVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNAPIRRNKEEPKARPLRVGDTEKPEPERSPPNRKRPANEKATDDYHYEKFKKMNRRY

SEQ ID NO: 17076 - protein, 175 aa, Homo sapiens
  Payload ID: 3425
  Gene Symbol: C9orf78
  Gene Name: chromosome 9 open reading frame 78
  ENSP ID: ENSP00000484941
MVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIISTEDAKARLLAEQQNKKKDSETSFVPTNMAVNYVQHNRFYHEELNAHTEKQRRAQGPALESR

SEQ ID NO: 17077 - protein, 1444 aa, Homo sapiens
  Payload ID: 3426
  Gene Symbol: C9orf84
  Gene Name: chromosome 9 open reading frame 84
  Uniprot ID: Q5VXU9
  ENSP ID: ENSP00000322108
MTDTSVLDQWKASFFVEDFLEKKTITRMVTQINCEFEEVVPSSNPDSQIEVEEVSLYTHMDYNEVFTPVSCLEKCSALQNQNQDLFIDDKGILFVSSRKHLPTLPTLLSRLKLFLVKDPLLDFKGQIFTEANFSRECFSLQETLEAFVKEDFCMDKVNFCQEKLEDTICLNEPSSFLIEYEFLIPPSLKPEIDIPSLSELKELLNPVPEIINYVDEKEKLFERDLTNKHGIEDIGDIKFSSTEILTIQSQSEPEECSKPGELEMPLTPLFLTCQHSSVNSLRTELQTFPLSPVCKINLLTAEESANEYYMMWQLERCRSPLNPFLLTVPRIQEPHSQYSVTDLKKIFSVKEESLVINLEKAEWWKQAGLNLKMMETLEHLNTYLCHDNLSSNDTKIEIFLPTKVLQLESCLEHKSHSSPIALIDEKSTNAHLSLPQKSPSLAKEVPDLCFSDDYFSDKGAAKEEKPKNDQEPVNRIIQKKENNDHFELDCTGPSIKSPSSSIIKKASFEHGKKQENDLDLLSDFIMLRNKYKTCTSKTEVTNSDEKHDKEACSLTLQEESPIVHINKTLEEINQERGTDSVIEIQASDSQCQAFCLLEAAASPILKNLVSLCTLPTANWKFATVIFDQTRFLLKEQEKVVSDAVRQGTIDEREMTFKHAALLHLLVTIRDVLLTCSLDTALGYLSKAKDIYNSILGPYLGDIWRQLEIVQFIRGKKPETNYKIQELQCQILSWMQSQQQIKVLIIIRMDSDGEKHFLIKILNKIEGLTLTVLHSNERKDFLESEGVLRGTSSCVVVHNQYIGADFPWSNFSFVVEYNYVEDSCWTKHCKELNIPYMAFKVILPDTVLERSTLLDRFGGFLLEIQIPYVFFASEGLLNTPDILQLLESNYNISLVERGCSESLKLFGSSECYVVVTIDEHTAIILQDLEELNYEKASDNIIMRLMALSLQYRYCWIILYTKETLNSEYLLTEKTLHHLALIYAALVSFGLNSEELDVKLIIAPGVEATALIIRQIADHSLMTSKRDPHEWLDKSWLKVSPSEEEMYLLDFPCINPLVAQLMLNKGPSLHWILLATLCQLQELLPEVPEKVLKHFCSITSLFKIGSSSITKSPQISSPQENRNQISTLSSQSSASDLDSVIQEHNEYYQYLGLGETVQEDKTTILNDNSSIMELKEISSFLPPVTSYNQTSYWKDSSCKSNIGQNTPFLINIESRRPAYNSFLNHSDSESDVFSLGLTQMNCETIKSPTDTQKRVSVVPRFINSQKRRTHEAKGFINKDVSDPIFSLEGTQSPLHWNFKKNIWEQENHPFNLQYGAQQTACNKLYSQKGNLFTDQQKCLSDESEGLTCESSKDETFWRELPSVPSLDLFRASDSNANQKEFNSLYFYQRAGKSLGQKRHHESSFNSGDKESLTGFMCSQLPQFKKRRLAYEKVPGRVDGQTRLRFF

SEQ ID NO: 17078 - protein, 488 aa, Homo sapiens
  Payload ID: 3426
  Gene Symbol: C9orf84
  Gene Name: chromosome 9 open reading frame 84
  Uniprot ID: Q5VXU9
  ENSP ID: ENSP00000363401
MFSALKYHAIDYLYENVVRKKFYRDALLLRIPSCLYQDESYHVAVTDNKFRRPWTRVSAVSVPGMTDTSVLDQWKASFFVEDFLEKKTITRMVTQINCEFEEVVPSSNPDSQIEVEEVSLYTHMDYNEVFTPVSCLEKCSALQNQNQDLFIDDKGILFVSSRKHLPTLPTLLSRLKLFLVKDPLLDFKGQIFTEANFSRECFSLQETLEAFVKEDFCMDKVNFCQEKLEDTICLNEPSSFLIEYEFLIPPSLKPEIDIPSLSELKELLNPVPEIINYVDEKEKLFERDLTNKHGIEDIGDIKFSSTEILTIQSQSEPEECSKPGELEMPLTPLFLTCQHSSVNSLRTELQTFPLSPVCKINLLTAEESANEYYMMWQLERCRSPLNPFLLTVPRIQEPHSQYSVTDLKKIFSVKEESLVINLEKAEWWKQAGLNLKMMETLEHLNTYLCHDNLSSNDTKIEIFLPTKVLQLECKYITVNISYVNIFRM

SEQ ID NO: 17079 - protein, 1444 aa, Homo sapiens; identical to SEQ ID NO: 17077
  Payload ID: 3426
  Gene Symbol: C9orf84
  Gene Name: chromosome 9 open reading frame 84
  Uniprot ID: Q5VXU9
  ENSP ID: ENSP00000363405

SEQ ID NO: 17080 - protein, 1370 aa, Homo sapiens
  Payload ID: 3426
  Gene Symbol: C9orf84
  Gene Name: chromosome 9 open reading frame 84
  ENSP ID: ENSP00000378257
MSETLGDELEILRGKMMQRRPRSAEVKYFYFFKILLRLRLAILKYLFIDDKGILFVSSRKHLPTLPTLLSRLKLFLVKDPLLDFKGQIFTEANFSRECFSLQETLEAFVKEDFCMDKVNFCQEKLEDTICLNEPSSFLIEYEFLIPPSLKPEIDIPSLSELKELLNPVPEIINYVDEKEKLFERDLTNKHGIEDIGDIKFSSTEILTIQSQSEPEECSKPGELEMPLTPLFLTCQHSSVNSLRTELQTFPLSPVCKINLLTAEESANEYYMMWQLERCRSPLNPFLLTVPRIQEPHSQYSVTDLKKIFSVKEESLVINLEKAEWWKQAGLNLKMMETLEHLNTYLCHDNLSSNDTKIEIFLPTKVLQLESCLEHKSHSSPIALIDEKSTNAHLSLPQKSPSLAKEVPDLCFSDDYFSDKGAAKEEKPKNDQEPVNRIIQKKENNDHFELDCTGPSIKSPSSSIIKKASFEHGKKQENDLDLLSDFIMLRNKYKTCTSKTEVTNSDEKHDKEACSLTLQEESPIVHINKTLEEINQERGTDSVIEIQASDSQCQAFCLLEAAASPILKNLVSLCTLPTANWKFATVIFDQTRFLLKEQEKVVSDAVRQGYLSKAKDIYNSILGPYLGDIWRQLEIVQFIRGKKPETNYKIQELQCQILSWMQSQQQIKVLIIIRMDSDGEKHFLIKILNKIEGLTLTVLHSNERKDFLESEGVLRGTSSCVVVHNQYIGADFPWSNFSFVVEYNYVEDSCWTKHCKELNIPYMAFKVILPDTVLERSTLLDRFGGFLLEIQIPYVFFASEGLLNTPDILQLLESNYNISLVERGCSESLKLFGSSECYVVVTIDEHTAIILQDLEELNYEKASDNIIMRLMALSLQYRYCWIILYTKETLNSEYLLTEKTLHHLALIYAALVSFGLNSEELDVKLIIAPGVEATALIIRQIADHSLMTSKRDPHEWLDKSWLKVSPSEEEMYLLDFPCINPLVAQLMLNKGPSLHWILLATLCQLQELLPEVPEKVLKHFCSITSLFKIGSSSITKSPQISSPQENRNQISTLSSQSSASDLDSVIQEHNEYYQYLGLGETVQEDKTTILNDNSSIMELKEISSFLPPVTSYNQTSYWKDSSCKSNIGQNTPFLINIESRRPAYNSFLNHSDSESDVFSLGLTQMNCETIKSPTDTQKRVSVVPRFINSQKRRTHEAKGFINKDVSDPIFSLEGTQSPLHWNFKKNIWEQENHPFNLQYGAQQTACNKLYSQKGNLFTDQQKCLSDESEGLTCESSKDETFWRELPSVPSLDLFRASDSNANQKEFNSLYFYQRAGKSLGQKRHHESSFNSGDKESLTGFMCSQLPQFKKRRLAYEKVPGRVDGQTRLRFF

SEQ ID NO: 17081 - protein, 1405 aa, Homo sapiens
  Payload ID: 3426
  Gene Symbol: C9orf84
  Gene Name: chromosome 9 open reading frame 84
  Uniprot ID: Q5VXU9
  ENSP ID: ENSP00000378259
MSETLGDELEILRGKMMQRRPRSAEVKYFYFFKILLRLRLAILKYLFIDDKGILFVSSRKHLPTLPTLLSRLKLFLVKDPLLDFKGQIFTEANFSRECFSLQETLEAFVKEDFCMDKVNFCQEKLEDTICLNEPSSFLIEYEFLIPPSLKPEIDIPSLSELKELLNPVPEIINYVDEKEKLFERDLTNKHGIEDIGDIKFSSTEILTIQSQSEPEECSKPGELEMPLTPLFLTCQHSSVNSLRTELQTFPLSPVCKINLLTAEESANEYYMMWQLERCRSPLNPFLLTVPRIQEPHSQYSVTDLKKIFSVKEESLVINLEKAEWWKQAGLNLKMMETLEHLNTYLCHDNLSSNDTKIEIFLPTKVLQLESCLEHKSHSSPIALIDEKSTNAHLSLPQKSPSLAKEVPDLCFSDDYFSDKGAAKEEKPKNDQEPVNRIIQKKENNDHFELDCTGPSIKSPSSSIIKKASFEHGKKQENDLDLLSDFIMLRNKYKTCTSKTEVTNSDEKHDKEACSLTLQEESPIVHINKTLEEINQERGTDSVIEIQASDSQCQAFCLLEAAASPILKNLVSLCTLPTANWKFATVIFDQTRFLLKEQEKVVSDAVRQGTIDEREMTFKHAALLHLLVTIRDVLLTCSLDTALGYLSKAKDIYNSILGPYLGDIWRQLEIVQFIRGKKPETNYKIQELQCQILSWMQSQQQIKVLIIIRMDSDGEKHFLIKILNKIEGLTLTVLHSNERKDFLESEGVLRGTSSCVVVHNQYIGADFPWSNFSFVVEYNYVEDSCWTKHCKELNIPYMAFKVILPDTVLERSTLLDRFGGFLLEIQIPYVFFASEGLLNTPDILQLLESNYNISLVERGCSESLKLFGSSECYVVVTIDEHTAIILQDLEELNYEKASDNIIMRLMALSLQYRYCWIILYTKETLNSEYLLTEKTLHHLALIYAALVSFGLNSEELDVKLIIAPGVEATALIIRQIADHSLMTSKRDPHEWLDKSWLKVSPSEEEMYLLDFPCINPLVAQLMLNKGPSLHWILLATLCQLQELLPEVPEKVLKHFCSITSLFKIGSSSITKSPQISSPQENRNQISTLSSQSSASDLDSVIQEHNEYYQYLGLGETVQEDKTTILNDNSSIMELKEISSFLPPVTSYNQTSYWKDSSCKSNIGQNTPFLINIESRRPAYNSFLNHSDSESDVFSLGLTQMNCETIKSPTDTQKRVSVVPRFINSQKRRTHEAKGFINKDVSDPIFSLEGTQSPLHWNFKKNIWEQENHPFNLQYGAQQTACNKLYSQKGNLFTDQQKCLSDESEGLTCESSKDETFWRELPSVPSLDLFRASDSNANQKEFNSLYFYQRAGKSLGQKRHHESSFNSGDKESLTGFMCSQLPQFKKRRLAYEKVPGRVDGQTRLRFF

SEQ ID NO: 17082 - protein, 157 aa, Homo sapiens
  Payload ID: 3427
  Gene Symbol: C9orf85
  Gene Name: chromosome 9 open reading frame 85
  Uniprot ID: Q96MD7
  ENSP ID: ENSP00000334289
MSSQKGNVARSRPQKHQNTFSFKNDKFDKSVQTKKINAKLHDGVCQRCKEVLEWRVKYSKYKPLSKPKKCVKCLQKTVKDSYHIMCRPCACELEVCAKCGKKEDIVIPLNKETEKIEHTENNLSSNHRRSCRRNEESDDDLDFDIDLEDTGGDHQMN

SEQ ID NO: 17083 - protein, 22 aa, Homo sapiens
  Payload ID: 3427
  Gene Symbol: C9orf85
  Gene Name: chromosome 9 open reading frame 85
  ENSP ID: ENSP00000366226
  MOD_RES (1)..(1): Any amino acid
XNDKFDKSVQTKSLSANSSHDV

SEQ ID NO: 17084 - protein, 179 aa, Homo sapiens
  Payload ID: 3427
  Gene Symbol: C9orf85
  Gene Name: chromosome 9 open reading frame 85
  Uniprot ID: Q96MD7
  ENSP ID: ENSP00000366230
MSSQKGNVARSRPQKHQNTFSFKNDKFDKSVQTKKINAKLHDGVCQRCKEVLEWRVKYSKYKPLSKPKKCVKCLQKTVKDSYHIMCRPCACELEVCAKCGKKEDIVIPWSLPLLPRLECSGRILAHHNLRLPCSSDSPASASRVAGTTGAHHHAQLIFVFLVEMGFHYVGQAGLELLTS

SEQ ID NO: 17085 - protein, 69 aa, Homo sapiens
  Payload ID: 3427
  Gene Symbol: C9orf85
  Gene Name: chromosome 9 open reading frame 85
  ENSP ID: ENSP00000431527
MSSQKGNVARSRPQKHQNTFSFKNDKFDKSVQTKKINAKLHDGVCQRCKEVLEWRVKYSKYKPLSKPKK

SEQ ID NO: 17086 - protein, 35 aa, Homo sapiens
  Payload ID: 3427
  Gene Symbol: C9orf85
  Gene Name: chromosome 9 open reading frame 85
  Uniprot ID: Q96MD7
  ENSP ID: ENSP00000433086
MSSQKGNVARSRPQKHQNTFSFKNDKFDKSVQTKC

SEQ ID NO: 17087 - protein, 44 aa, Homo sapiens
  Payload ID: 3427
  Gene Symbol: C9orf85
  Gene Name: chromosome 9 open reading frame 85
  ENSP ID: ENSP00000434838
MSSQKGNVARSRPQKHQNTFSFKNDKFDKSVQTKSLSANSSHDV

SEQ ID NO: 17088 - protein, 168 aa, Homo sapiens
  Payload ID: 3428
  Gene Symbol: C9orf9
  Gene Name: chromosome 9 open reading frame 9
  Uniprot ID: Q96E40
  ENSP ID: ENSP00000298546
MNEVKESLRSIEQKYKLFQQQQLTFTAALEHCRENAHDKIRPISSIGQVQSYMEHYCNSSTDRRVLLMFLDICSELNKLCQHFEAVHSGTPVTNNLLEKCKTLVSQSNDLSSLRAKYPHDVVNHLSCDEARNHYGGVVSLIPLILDLMKEWIAHSEKLPRKVLQHGTT

SEQ ID NO: 17089 - protein, 222 aa, Homo sapiens
  Payload ID: 3428
  Gene Symbol: C9orf9
  Gene Name: chromosome 9 open reading frame 9
  Uniprot ID: Q96E40
  ENSP ID: ENSP00000348659
MNEVKESLRSIEQKYKLFQQQQLTFTAALEHCRENAHDKIRPISSIGQVQSYMEHYCNSSTDRRVLLMFLDICSELNKLCQHFEAVHSGTPVTNNLLEKCKTLVSQSNDLSSLRAKYPHDVVNHLSCDEARNHYGGVVSLIPLILDLMKEWIAHSEKLPRKVLQHVSEPQAHQESTRGAARPAQAIGTQPRATKHKCRQLTKASLKPRGCSKPPWRPPGGKL

SEQ ID NO: 17090 - protein, 222 aa, Homo sapiens; identical to SEQ ID NO: 17089
  Payload ID: 3428
  Gene Symbol: C9orf9
  Gene Name: chromosome 9 open reading frame 9
  Uniprot ID: Q96E40
  ENSP ID: ENSP00000361209

SEQ ID NO: 17091 - protein, 342 aa, Homo sapiens
  Payload ID: 3429
  Gene Symbol: C9orf91
  Gene Name: chromosome 9 open reading frame 91
  Uniprot ID: Q5VZI3
  ENSP ID: ENSP00000288502
MACEPQVDPGATGPLPPSSPGWSALPGGSPPGWGQELHNGQVLTVLRIDNTCAPISFDLGAAEEQLQTWGIQVPADQYRSLAESALLEPQVRRYIIYNSRPMRLAFAVVFYVVVWANIYSTSQMFALGNHWAGMLLVTLAAVSLTLTLVLVFERHQKKANTNTDLRLAAANGALLRHRVLLGVTDTVEGCQSVIQLWFVYFDLENCVQFLSDHVQEMKTSQESLLRSRLSQLCVVMETGVSPATAEGPENLEDAPLLPGNSCPNERPLMQTELHQLVPEAEPEEMARQLLAVFGGYYIRLLVTSQLPQAMGTRHTNSPRIPCPCQLIEAYILGTGCCPFLAR

SEQ ID NO: 17092 - protein, 343 aa, Homo sapiens
  Payload ID: 3429
  Gene Symbol: C9orf91
  Gene Name: chromosome 9 open reading frame 91
  Uniprot ID: Q5VZI3
  ENSP ID: ENSP00000363161
MACEPQVDPGATGPLPPSSPGWSALPGGSPPGWGQELHNGQVLTVLRIDNTCAPISFDLGAAEEQLQTWGIQQVPADQYRSLAESALLEPQVRRYIIYNSRPMRLAFAVVFYVVVWANIYSTSQMFALGNHWAGMLLVTLAAVSLTLTLVLVFERHQKKANTNTDLRLAAANGALLRHRVLLGVTDTVEGCQSVIQLWFVYFDLENCVQFLSDHVQEMKTSQESLLRSRLSQLCVVMETGVSPATAEGPENLEDAPLLPGNSCPNERPLMQTELHQLVPEAEPEEMARQLLAVFGGYYIRLLVTSQLPQAMGTRHTNSPRIPCPCQLIEAYILGTGCCPFLAR

SEQ ID NO: 17093 - protein, 108 aa, Homo sapiens
  Payload ID: 3430
  Gene Symbol: C9orf92
  Gene Name: chromosome 9 open reading frame 92
  Uniprot ID: A6NGG3
  ENSP ID: ENSP00000370058
MELNTNIKSKKGLGRRNLKPMNGAWPPARREMARFQRTKEREEDRCSLNIYYVRNTTQGTAPACVGKRMQPSPTGKGGKCCTVHGLTRKIHNVQPNLQSPILSAACVD

SEQ ID NO: 17094 - protein, 77 aa, Homo sapiens
  Payload ID: 3430
  Gene Symbol: C9orf92
  Gene Name: chromosome 9 open reading frame 92
  Uniprot ID: A6NGG3
  ENSP ID: ENSP00000370060
MARFQRTKEREEDRCSLNIYYVRNTTQGTAPACVGKRMQPSPTGKGGKCCTVHGLTRKIHNVQPNLQSPILSAACVD

SEQ ID NO: 17095 - protein, 73 aa, Homo sapiens
  Payload ID: 3430
  Gene Symbol: C9orf92
  Gene Name: chromosome 9 open reading frame 92
  ENSP ID: ENSP00000412109
  MOD_RES (1)..(1): Any amino acid
XNGAWPPARREMARFQRTKEREEDRCSLNIYYVRNTTQGTAPACSQGRYIMYSRIYSLLFCQLLVLIKTSIKI

SEQ ID NO: 17096 - protein, 812 aa, Homo sapiens
  Payload ID: 3431
  Gene Symbol: CHAMP1
  Gene Name: chromosome alignment maintaining phosphoprotein 1
  Uniprot ID: Q96JM3
  ENSP ID: ENSP00000354730
MEAFQELRKPSARLECDHCSFRGTDYENVQIHMGTIHPEFCDEMDAGGLGKMIFYQKSAKLFHCHKCFFTSKMYSNVYYHITSKHASPDKWNDKPKNQLNKETDPVKSPPLPEHQKIPCNSAEPKSIPALSMETQKLGSVLSPESPKPTPLTPLEPQKPGSVVSPELQTPLPSPEPSKPASVSSPEPPKSVPVCESQKLAPVPSPEPQKPAPVSPESVKATLSNPKPQKQSHFPETLGPPSASSPESPVLAASPEPWGPSPAASPESRKSARTTSPEPRKPSPSESPEPWKPFPAVSPEPRRPAPAVSPGSWKPGPPGSPRPWKSNPSASSGPWKPAKPAPSVSPGPWKPIPSVSPGPWKPTPSVSSASWKSSSVSPSSWKSPPASPESWKSGPPELRKTAPTLSPEHWKAVPPVSPELRKPGPPLSPEIRSPAGSPELRKPSGSPDLWKLSPDQRKTSPASLDFPESQKSSRGGSPDLWKSSFFIEPQKPVFPETRKPGPSGPSESPKAASDIWKPVLSIDTEPRKPALFPEPAKTAPPASPEARKRALFPEPRKHALFPELPKSALFSESQKAVELGDELQIDAIDDQKCDILVQEELLASPKKLLEDTLFPSSKKLKKDNQESSDAELSSSEYIKTDLDAMDIKGQESSSDQEQVDVESIDFSKENKMDMTSPEQSRNVLQFTEEKEAFISEEEIAKYMKRGKGKYYCKICCCRAMKKGAVLHHLVNKHNVHSPYKCTICGKAFLLESLLKNHVAAHGQSLLKCPRCNFESNFPRGFKKHLTHCQSRHNEEANKKLMEALEPPLEEQQI

SEQ ID NO: 17097 - protein, 145 aa, Homo sapiens
  Payload ID: 3431
  Gene Symbol: CHAMP1
  Gene Name: chromosome alignment maintaining phosphoprotein 1
  ENSP ID: ENSP00000474448
MEAFQELRKPSARLECDHCSFRGTDYENVQIHMGTIHPEFCDEMDAGGLGKMIFYQKSAKLFHCHKCFFTSKMYSNVYYHITSKHASPDKWNDKPKNQLNKETDPVKSPPLPEHQKIPCNSAEPKSIPALSMETQKLGSVLSPES

SEQ ID NO: 17098 - protein, 975 aa, Homo sapiens
  Payload ID: 3432
  Gene Symbol: CHTF18
  Gene Name: chromosome transmission fidelity  factor 18
  Uniprot ID: Q8WVB6
  ENSP ID: ENSP00000262315
MEDYEQELCGVEDDFHNQFAAELEVLAELEGASTPSPSGVPLFTAGRPPRTFEEALARGDAASSPAPAASVGSSQGGARKRQVDADLQPAGSLPHAPRIKRPRLQVVKRLNFRSEEMEEPPPPDSSPTDITPPPSPEDLAELWGHGVSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 17099 - protein, 975 aa, Homo sapiens
  Payload ID: 3432
  Gene Symbol: CHTF18
  Gene Name: chromosome transmission fidelity  factor 18
  ENSP ID: ENSP00000313029
MEDYEQELCGVEDDFHNQFAAELEVLAELEGASTPSPSGVPLFTAGRPPRTFEEALARGDAASSPAPAASVGSSQGGARKRQVDADLQPAGSLPHAPRIKRPRLQVVKRLNFRSEEMEEPPPPDSSPTDITPPPSPEDLAELWGHGFSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 17100 - protein, 456 aa, Homo sapiens
  Payload ID: 3432
  Gene Symbol: CHTF18
  Gene Name: chromosome transmission fidelity  factor 18
  ENSP ID: ENSP00000399111
MEDYEQELCGVEDDFHNQFAAELEVLAELEAGASTPSPSGVPLFTAGRPPRTFEEALARGDAASSPAPAASVGSSQGGARKRQVDADLQPAGSLPHAPRIKRPRLQVVKRLNFRSEEMEEPPPPDSSPTDITPPPSPEDLAELWGHGVSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVVGSLMPGPPSTSS

SEQ ID NO: 17101 - protein, 1003 aa, Homo sapiens
  Payload ID: 3432
  Gene Symbol: CHTF18
  Gene Name: chromosome transmission fidelity  factor 18
  Uniprot ID: Q8WVB6
  ENSP ID: ENSP00000406252
MEDYEQELCGVEDDFHNQFAAELEVLAELEGASTPSPSGVPLFTAGRPPRTFEEALARGDAASSPAPAASVGSSQGGARKRQVDADLQPAGSLPHGRLAALPQGLRSGREAEEASGSLHVSPPAPRIKRPRLQVVKRLNFRSEEMEEPPPPDSSPTDITPPPSPEDLAELWGHGVSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 17102 - protein, 264 aa, Homo sapiens
  Payload ID: 3432
  Gene Symbol: CHTF18
  Gene Name: chromosome transmission fidelity  factor 18
  ENSP ID: ENSP00000412015
  MOD_RES (1)..(1): Any amino acid
XTPPPSPEDLAELWGHGVSEAAADVGLTRASPAARNPVLRRPPILEDYVHVTSTEGVRAYLVLRADPMAPGVQLTHLDGFIPLAPLSSLPPLTGQLTGGSLLHVPWRGGGQLDLLGVSLASLKKQVDGERRERLLQEAQKLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQK

SEQ ID NO: 17103 - protein, 81 aa, Homo sapiens
  Payload ID: 3432
  Gene Symbol: CHTF18
  Gene Name: chromosome transmission fidelity  factor 18
  ENSP ID: ENSP00000454679
  MOD_RES (1)..(1): Any amino acid
XSRSTASGGSGCFRRPRSFQTPCTVSGRGRRRQPSPWGPLRRSRLTVKTPPVTASGWMSLHPATTRSCSVMTSPTAACSSG

SEQ ID NO: 17104 - protein, 103 aa, Homo sapiens
  Payload ID: 3432
  Gene Symbol: CHTF18
  Gene Name: chromosome transmission fidelity  factor 18
  ENSP ID: ENSP00000456998
MEDYEQELCGVEDDFHNQFAAELEGRRLRRPPGSPCSPRADPRGRSRRPLPEGTRPPVPPQPHLWAAARAAPGRGRWTPTCSRPGPCPTPPGSNGLGCRWSRG

SEQ ID NO: 17105 - protein, 1184 aa, Homo sapiens
  Payload ID: 3432
  Gene Symbol: CHTF18
  Gene Name: chromosome transmission fidelity  factor 18
  ENSP ID: ENSP00000486314
MHVNASARRWGRGGAAALPGPAASPRRPAPRTGPVGRPTLAPSPSRAHAHAKTNLLPGRAVQAPDAVPGAGSSRAPARWRPRDPGSSAPDAWQRFRPAPLRAQPRPPPRPAPGPPPPRKGGCGGQWRAPQDRTRGLRSRNSPRPPLAQPRLRHANQWRAPPGTPAADWRRPARSGRAVRDGGGGAGGSERELGLADGMEDYEQELCGVEDDFHNQFAAELEVLAELEGASTPSPSGVPLFTAGRPPRTFEEALARGDAASSPAPAASVGSSQGGARKRQVDADLQPAGSLPHAPRIKRPRLQVVKRLNFRSEEMEEPPPPDSSPTDITPPPSPEDLAELWGHGFSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEGMRADPGVLAALCEKTDNDIRACINTLQFLYSRGQRELSVRDVQATRVGLKDQRRGLFSVWQEVFQLPRAQRSSQHVSVLTCHGTPGDAGLVVLQDMGDAGLGLWDVLLLAWTRRGTFPGRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 17106 - protein, 524 aa, Homo sapiens
  Payload ID: 3433
  Gene Symbol: CHTF8
  Gene Name: chromosome transmission fidelity  factor 8
  Uniprot ID: P0CG12
  ENSP ID: ENSP00000305687
MKEPRIFPRERPTPWTRAPLPPRGRLDGSLGPQGGPVLNTGHPLGVNSDPFLMAAGSLGGNLTPFPRNPSPFPASSGSLASNPAPFPAGARDPSMASFPRGMNPTGTGAVSFPRPGGLLGPGPGPGPTLNPRTGALPGPGPLSNPRLGGLPGPGPMSNPRAGGLLGAGPDPRGGGPMGPGSGPNLRAGVLLTSGNGPPNPRPVGLGPGPNPNLRSGFLGTNPAPRSGVFPGPGLGPNPRPSGLGPGPNLDARAGGLLGTGSGLNLRMAGPQGLDLAPILRAAGLLGANSASFSQASGNMGTSPSSMARVPGPMGPNSGPSSRGIGLPGPNPSPMSRAPGPIGPNSAHFSRPVGPMGVNANPFPRGAGSSAFSQSSGTLASNPATFQRSAGLQGSNPTIFPRASGPLGPNPANFPRATGLQGPSPTTFPRSTGPLGPGQVTFPRPAAGHLGPSPAGPVGINPAPFTRPTGTLGLNPASFPRMNGPAGKSFVPFPRVGSLPGTNPAAFPRPGGPMAAMYPNGMLPP

SEQ ID NO: 17107 - protein, 121 aa, Homo sapiens
  Payload ID: 3433
  Gene Symbol: CHTF8
  Gene Name: chromosome transmission fidelity  factor 8
  Uniprot ID: P0CG13
  ENSP ID: ENSP00000381290
MVQIVISSARAGGLAEWVLMELQGEIEARYSTGLAGNLLGDLHYTTEGIPVLIVGHHILYGKIIHLEKPFAVLVKHTPGDQDCDELGRETGTRYLVTALIKDKILFKTRPKPIITSVPKKV

SEQ ID NO: 17108 - protein, 121 aa, Homo sapiens; identical to SEQ ID NO: 17107
  Payload ID: 3433
  Gene Symbol: CHTF8
  Gene Name: chromosome transmission fidelity  factor 8
  Uniprot ID: P0CG13
  ENSP ID: ENSP00000408367

SEQ ID NO: 17109 - protein, 12 aa, Homo sapiens
  Payload ID: 3433
  Gene Symbol: CHTF8
  Gene Name: chromosome transmission fidelity  factor 8
  ENSP ID: ENSP00000427718
MVQIVISRESLC

SEQ ID NO: 17110 - protein, 12 aa, Homo sapiens
  Payload ID: 3433
  Gene Symbol: CHTF8
  Gene Name: chromosome transmission fidelity  factor 8
  ENSP ID: ENSP00000427728
MVQIVISRESLC

SEQ ID NO: 17111 - protein, 144 aa, Homo sapiens
  Payload ID: 3433
  Gene Symbol: CHTF8
  Gene Name: chromosome transmission fidelity  factor 8
  ENSP ID: ENSP00000428130
  MOD_RES (1)..(1): Any amino acid
XAVLAAAATAAGGSVVARWPRGAALGGRHCSARAGGLAEWVLMELQGEIEARYSTGLAGNLLGDLHYTTEGIPVLIVGHHILYGKIIHLEKPFAVLVKHTPGDQDCDELGRETGTRYLVTALIKDKILFKTRPKPIITSVPKKV

SEQ ID NO: 17112 - protein, 58 aa, Homo sapiens
  Payload ID: 3433
  Gene Symbol: CHTF8
  Gene Name: chromosome transmission fidelity  factor 8
  ENSP ID: ENSP00000430079
MVQIVISSARAGGLAEWVLMELQGEIEARYSTGLAGNLLGDLHYTTEGYIGLQVPVHM

SEQ ID NO: 17113 - protein, 75 aa, Homo sapiens
  Payload ID: 3433
  Gene Symbol: CHTF8
  Gene Name: chromosome transmission fidelity  factor 8
  ENSP ID: ENSP00000430899
MVQIVISSARAGGLAEWVLMELQGEIEARYSTGLAGNLLGDLHYTTELHQAHWLQIQHLSRLVLVTQVWLLFQEG

SEQ ID NO: 17114 - protein, 104 aa, Homo sapiens
  Payload ID: 3433
  Gene Symbol: CHTF8
  Gene Name: chromosome transmission fidelity  factor 8
  ENSP ID: ENSP00000455402
  MOD_RES (1)..(1): Any amino acid
XSARGGGDGGGRFGCRPLAARRRARRPPLQGIPVLIVGHHILYGKIIHLEKPFAVLVKHTPGDQDCDELGRETGTRYLVTALIKDKILFKTRPKPIITSVPKKV

SEQ ID NO: 17115 - protein, 99 aa, Homo sapiens
  Payload ID: 3433
  Gene Symbol: CHTF8
  Gene Name: chromosome transmission fidelity  factor 8
  ENSP ID: ENSP00000455699
MVQIVISSARAGGLAEWVLMELQGEIEARYSTGLAGNLLGDLHYTTEVRGLFFPCLMPQESKLHQGGAPRTQSEDCLRFVIQGLANLRCSLLVLPLPLQ

SEQ ID NO: 17116 - protein, 65 aa, Homo sapiens
  Payload ID: 3433
  Gene Symbol: CHTF8
  Gene Name: chromosome transmission fidelity  factor 8
  ENSP ID: ENSP00000462519
HILYGKIIHLEKPFAVLVKHTPGDQDCDELGRETGTRYLVTALIKDKILFKTRPKPIITSVPKKV

SEQ ID NO: 17117 - protein, 301 aa, Homo sapiens
  Payload ID: 3434
  Gene Symbol: CXorf21
  Gene Name: chromosome X open reading frame 21
  Uniprot ID: Q9HAI6
  ENSP ID: ENSP00000368245
MLSEGYLSGLEYWNDIHWSCASYNEQVAGEKEEETNSVATLSYSSVDETQVRSLYVSCKSSGKFISSVHSRESQHSRSQRVTVLQTNPNPVFESPNLAAVEICRDASRETYLVPSSCKSICKNYNDLQIAGGQVMAINSVTTDFPSESSFEYGPLLKSSEIPLPMEDSISTQPSDFPQKPIQRYSSYWRITSIKEKSSLQMQNPISNAVLNEYLEQKVVELYKQYIMDTVFHDSSPTQILASELIMTSVDQISLQVSREKNLETSKARDIVFSRLLQLMSTEITEISTPSLHISQYSNVNP

SEQ ID NO: 17118 - protein, 234 aa, Homo sapiens
  Payload ID: 3435
  Gene Symbol: CXorf23
  Gene Name: chromosome X open reading frame 23
  ENSP ID: ENSP00000342104
  MOD_RES (1)..(1): Any amino acid
XSQKLPDVKPSPINLRKKSLTVKVDVKKTVDTFRVASSYSTERQMSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKGLALSPRLECGVTITAYCSLYLQDSSYLPPQPPE

SEQ ID NO: 17119 - protein, 711 aa, Homo sapiens
  Payload ID: 3435
  Gene Symbol: CXorf23
  Gene Name: chromosome X open reading frame 23
  Uniprot ID: A2AJT9
  ENSP ID: ENSP00000369004
MARSRSRSPRWKHRSLSPVPRNAEHYKQRHSHGHYGCEYRKDPKRPVAWRMDSEKHGQSKPRIPSRGNIYYQSYEHRSPSPNIRNSLENVYMYKPHRGYSPGRGDSNRRAQYMPKYSEGIPYKEHERNSYPQKVQGGHSPDDHRVRGSGKGGKPPQRSIADSFRFEGKWHEDELRHQRIQEEKYSQSTRRGSEDFETRSSFQKRYPEDRDFRKYGHTSKRPKDVERYESREPARNPKWKPEHSLPPYQEDTDQWNLGPQTYRHAEREHPETSSATKVSYDYRHKRPKLLDGDQDFSDGRTQKYCKEEDRKYSFQKGPLNRELDCFNTGRGRETQDGQVKEPFKPSKKDSIACTYSNKNDVDLRSSNDKWKEKIKKEGDCRKESNSSSNQLDKSQKLPDVKPSPINLRKKSLTVKVDVKKTVDTFRVASSYSTERQMSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKVKNVHTDGFQKPTHFIKSNFRKCIEKPYMNYTTQRKDIITHKPFEVEGNHRNTRVRPFKSNFRGGRCQPNYKSGLVQKSLYIQAKYQRLRFTGPRGFITHKFRERLMRKKKEYTDVATGI

SEQ ID NO: 17120 - protein, 682 aa, Homo sapiens
  Payload ID: 3435
  Gene Symbol: CXorf23
  Gene Name: chromosome X open reading frame 23
  Uniprot ID: A2AJT9
  ENSP ID: ENSP00000369009
MARSRSRSPRWKHRSLSPVPRNAEHYKQRHSHGHYGCEYRKDPKRPVAWRMDSEKHGQSKPRIPSRGNIYYQSYEHRSPSPNIRNSLENVYMYKPHRGYSPGRGDSNRRAQYMPKYSEGIPYKEHERNSYPQKVQGGHSPDDHRVRGSGKGGKPPQRSIADSFRFEGKWHEDELRHQRIQEEKYSQSTRRGSEDFETRSSFQKRYPEDRDFRKYGHTSKRPKDVERYESREPARNPKWKPEHSLPPYQEDTDQWNLGPQTYRHAEREHPETSSATKVSYDYRHKRPKLLDGDQDFSDGRTQKYCKEEDRKYSFQKGPLNRELDCFNTGRGRETQDGQVKEPFKPSKKDSIACTYSNKNDVDLRSSNDKWKEKIKKEGDCRKESNSSSNQLDKSQKLPDVKPSPINLRKKSLTVKVDVKKTVDTFRVASSYSTERQMSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKNYTTQRKDIITHKPFEVEGNHRNTRVRPFKSNFRGGRCQPNYKSGLVQKSLYIQAKYQRLRFTGPRGFITHKFRERLMRKKKEYTDVATGI

SEQ ID NO: 17121 - protein, 240 aa, Homo sapiens
  Payload ID: 3435
  Gene Symbol: CXorf23
  Gene Name: chromosome X open reading frame 23
  ENSP ID: ENSP00000437272
MSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKNYTTQRKDIITHKPFEVEGNHRNTRVRPFKSNFRGGRCQPNYKSGLVQKSLYIQAKYQRLRFTGPRGFITHKFRERLMRKKKVP

SEQ ID NO: 17122 - protein, 182 aa, Homo sapiens
  Payload ID: 3436
  Gene Symbol: CXorf36
  Gene Name: chromosome X open reading frame 36
  Uniprot ID: Q9H7Y0
  ENSP ID: ENSP00000367168
MEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRRICASASAPKTCSIERVLRKTERFQKWLQAKRLTPDLVQDCHQGQRELKFLCMLR

SEQ ID NO: 17123 - protein, 433 aa, Homo sapiens
  Payload ID: 3436
  Gene Symbol: CXorf36
  Gene Name: chromosome X open reading frame 36
  Uniprot ID: Q9H7Y0
  ENSP ID: ENSP00000381086
MEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRRICASASAPKTCSIERVLRKTERFQKWLQAKRLTPDLVQGLASPLLRCPSQRLLDRVVRRYAEVADAGSIFMDHFTDRDKLRLLYTLAVNSHPILLQIFPGAEGWPLPKYLGSCGRFLVSTSTRPLQEFYDAPPDQAADLAYQLLGVLESLRSNDLNYFFYFTHIDAGMFGVFNNGHLFIRDASAVGVIDKQEGSQEANRAGENKDIFSCLVSGCQAQLPSCESISEKQSLVLVCQKLLPRLLQGRFPSPVQDDIDSILVQCGDSIRPDPEVLGAASQLKDILRPLRTCDSRFAYRYPDCKYNDKF

SEQ ID NO: 17124 - protein, 319 aa, Homo sapiens
  Payload ID: 3437
  Gene Symbol: CXorf38
  Gene Name: chromosome X open reading frame 38
  Uniprot ID: Q8TB03
  ENSP ID: ENSP00000330488
MVLSELAARLNCAEYKNWVKAGHCLLLLRSCLQGFVGREVLSFHRGLLAAAPGLGPRAVCRGGSRCSPRARQFQPQCQVCAEWKREILRHHVNRNGDVHWGNCRPGRWPVDAWEVAKAFMPRGLADKQGPEECDAVALLSLINSCDHFVVDRKKVTEVIKCRNEIMHSSEMKVSSTWLRDFQMKIQNFLNEFKNIPEIVAVYSRIEQLLTSDWAVHIPEEDQRDGCECEMGTYLSESQVNEIEMQLLKEKLQEIYLQAEEQEVLPEELSNRLEVVKEFLRNNEDLRNGLTEDMQKLDSLCLHQKLDSQEPGRQTPDRKA

SEQ ID NO: 17125 - protein, 200 aa, Homo sapiens
  Payload ID: 3437
  Gene Symbol: CXorf38
  Gene Name: chromosome X open reading frame 38
  Uniprot ID: Q8TB03
  ENSP ID: ENSP00000367677
MPRGLADKQGPEECDAVALLSLINSCDHFVVDRKKVTEVIKCRNEIMHSSEMKVSSTWLRDFQMKIQNFLNEFKNIPEIVAVYSRIEQLLTSDWAVHIPEEDQRDGCECEMGTYLSESQVNEIEMQLLKEKLQEIYLQAEEQEVLPEELSNRLEVVKEFLRNNEDLRNGLTEDMQKLDSLCLHQKLDSQEPGRQTPDRKA

SEQ ID NO: 17126 - protein, 200 aa, Homo sapiens; identical to SEQ ID NO: 17125
  Payload ID: 3437
  Gene Symbol: CXorf38
  Gene Name: chromosome X open reading frame 38
  Uniprot ID: Q8TB03
  ENSP ID: ENSP00000367683

SEQ ID NO: 17127 - protein, 158 aa, Homo sapiens
  Payload ID: 3438
  Gene Symbol: CXorf40A
  Gene Name: chromosome X open reading frame 40A
  Uniprot ID: Q8TE69
  ENSP ID: ENSP00000420882
MKFGCLSFRQPYAGFVLNGIKTVETRWRPLLSSQRNCTIAVHIAHRDWEGDAWRELLVERLGMTPAQIQALLRKGEKFGRGVIAGLVDIGETLQCPEDLTPDEVVELENQAVLTNLKQKYLTVISNPRWLLEPIPRKGGKDVFQVDIPEHLIPLGHEV

SEQ ID NO: 17128 - protein, 158 aa, Homo sapiens; identical to SEQ ID NO: 17127
  Payload ID: 3438
  Gene Symbol: CXorf40A
  Gene Name: chromosome X open reading frame 40A
  Uniprot ID: Q8TE69
  ENSP ID: ENSP00000421745

SEQ ID NO: 17129 - protein, 146 aa, Homo sapiens
  Payload ID: 3438
  Gene Symbol: CXorf40A
  Gene Name: chromosome X open reading frame 40A
  ENSP ID: ENSP00000422312
MKFGCLSFRQPYAGFVLNGIKTVETRWRPLLSSQRNCTIAVHIAHRDWEGDAWRELLVERLGMTPAQIQALLRKGEKFGRGVIAGLVDIGETLQCPEDLTPDEVVELENQAVLTNLKQKYLTVISNPRWLLEPIPRKGGKDVFQNP

SEQ ID NO: 17130 - protein, 158 aa, Homo sapiens; identical to SEQ ID NO: 17127
  Payload ID: 3438
  Gene Symbol: CXorf40A
  Gene Name: chromosome X open reading frame 40A
  Uniprot ID: Q8TE69
  ENSP ID: ENSP00000422512

SEQ ID NO: 17131 - protein, 158 aa, Homo sapiens; identical to SEQ ID NO: 17127
  Payload ID: 3438
  Gene Symbol: CXorf40A
  Gene Name: chromosome X open reading frame 40A
  Uniprot ID: Q8TE69
  ENSP ID: ENSP00000423099

SEQ ID NO: 17132 - protein, 146 aa, Homo sapiens; identical to SEQ ID NO: 17129
  Payload ID: 3438
  Gene Symbol: CXorf40A
  Gene Name: chromosome X open reading frame 40A
  ENSP ID: ENSP00000423160

SEQ ID NO: 17133 - protein, 30 aa, Homo sapiens
  Payload ID: 3438
  Gene Symbol: CXorf40A
  Gene Name: chromosome X open reading frame 40A
  ENSP ID: ENSP00000423447
MKFGCLSFRQPYAGFVLNGIKTVETRWRPL

SEQ ID NO: 17134 - protein, 146 aa, Homo sapiens; identical to SEQ ID NO: 17129
  Payload ID: 3438
  Gene Symbol: CXorf40A
  Gene Name: chromosome X open reading frame 40A
  ENSP ID: ENSP00000423708

SEQ ID NO: 17135 - protein, 158 aa, Homo sapiens; identical to SEQ ID NO: 17127
  Payload ID: 3438
  Gene Symbol: CXorf40A
  Gene Name: chromosome X open reading frame 40A
  Uniprot ID: Q8TE69
  ENSP ID: ENSP00000425520

SEQ ID NO: 17136 - protein, 96 aa, Homo sapiens
  Payload ID: 3438
  Gene Symbol: CXorf40A
  Gene Name: chromosome X open reading frame 40A
  ENSP ID: ENSP00000426158
MTPAQIQALLRKGEKFGRGVIAGLVDIGETLQCPEDLTPDEVVELENQAVLTNLKQKYLTVISNPRWLLEPIPRKGGKDVFQVDIPEHLIPLGHEV

SEQ ID NO: 17137 - protein, 158 aa, Homo sapiens; identical to SEQ ID NO: 17127
  Payload ID: 3438
  Gene Symbol: CXorf40A
  Gene Name: chromosome X open reading frame 40A
  Uniprot ID: Q8TE69
  ENSP ID: ENSP00000427540

SEQ ID NO: 17138 - protein, 158 aa, Homo sapiens
  Payload ID: 3439
  Gene Symbol: CXorf40B
  Gene Name: chromosome X open reading frame 40B
  Uniprot ID: Q96DE9
  ENSP ID: ENSP00000347339
MKFGCLSFRQPYAGFVLNGIKTVETRWRPLLSSQRNCTIAVHIAHRDWEGDACRELLVERLGMTPAQIQALLRKGEKFGRGVIAGLVDIGETLQCPEDLTPDEVVELENQAALTNLKQKYLTVISNPRWLLEPIPRKGGKDVFQVDIPEHLIPLGHEV

SEQ ID NO: 17139 - protein, 158 aa, Homo sapiens; identical to SEQ ID NO: 17138
  Payload ID: 3439
  Gene Symbol: CXorf40B
  Gene Name: chromosome X open reading frame 40B
  Uniprot ID: Q96DE9
  ENSP ID: ENSP00000359432

SEQ ID NO: 17140 - protein, 158 aa, Homo sapiens; identical to SEQ ID NO: 17138
  Payload ID: 3439
  Gene Symbol: CXorf40B
  Gene Name: chromosome X open reading frame 40B
  Uniprot ID: Q96DE9
  ENSP ID: ENSP00000359434

SEQ ID NO: 17141 - protein, 146 aa, Homo sapiens
  Payload ID: 3439
  Gene Symbol: CXorf40B
  Gene Name: chromosome X open reading frame 40B
  ENSP ID: ENSP00000417546
MKFGCLSFRQPYAGFVLNGIKTVETRWRPLLSSQRNCTIAVHIAHRDWEGDACRELLVERLGMTPAQIQALLRKGEKFGRGVIAGLVDIGETLQCPEDLTPDEVVELENQAALTNLKQKYLTVISNPRWLLEPIPRKGGKDVFQNP

SEQ ID NO: 17142 - protein, 147 aa, Homo sapiens
  Payload ID: 3439
  Gene Symbol: CXorf40B
  Gene Name: chromosome X open reading frame 40B
  ENSP ID: ENSP00000474324
MKFGCLSFRQPYAGFVLNGIKTVETRWRPLLSSQRNCTIAVHIAHRDWEGDACRELLVERLGMTPAQIQALLRKGEKFGRGVIAGLVDIGETLQCPEDLTPDEVVELENQAALTNLKQKYLTVISNPRWLLEPIPRKGGKDVFQVDI

SEQ ID NO: 17143 - protein, 45 aa, Homo sapiens
  Payload ID: 3439
  Gene Symbol: CXorf40B
  Gene Name: chromosome X open reading frame 40B
  ENSP ID: ENSP00000474715
MKFGCLSFRQPYAGFVLNGIKTVETRWRPLLSSQRNCTIAVHIAH

SEQ ID NO: 17144 - protein, 514 aa, Homo sapiens
  Payload ID: 3440
  Gene Symbol: CXorf49
  Gene Name: chromosome X open reading frame 49
  Uniprot ID: A8MYA2
  ENSP ID: ENSP00000480355
MSSPDKVSVCGAGFDLEGGKKAGSRTASPGAPGAHSHGLDLGVPGSGDGKSESGFTDPEGFSFESESELIEQGRVVLWGREGRPGTPVDDQGDVVDYSFYLADEPAAIVPPPSVQGHPFPEGAAAEGSAENWADAEVGPSGRDVLGHSPGKWQQASAGRLHLCGPGPVRAWKNPERGSKSRWSLRVDPQQPSAKGPTRLPTHDSDSADESSDLPLMKVGICRNEGSQAKPGSPKKRADTSRQASFHCKESYLPVPGRFLTSAPRGLTPVAERPAVGELEDSPQKKMQSRAWGKVEVRPSCSGAAAAGALPQGLSRRKMAGGKKSLGGASQLALGRGFPACGERLSAAPPEPATFPPFSGVRPQGMSKKPQKPKHSSPGKKPAGRKTRESQAAAREDNDPNRDEVPRAQLPTHRPGLPRLSVRRGEFSSSDPNIRAPQLPGTSEPSAYSPGGLVPRRHAPSGNQQPPVHPPRPERQQQPPGAQGCPRCIWLQREIEDLTQQLAAMQFLTDKFQDL

SEQ ID NO: 17145 - protein, 514 aa, Homo sapiens; identical to SEQ ID NO: 17144
  Payload ID: 3441
  Gene Symbol: CXorf49B
  Gene Name: chromosome X open reading frame 49B
  Uniprot ID: A8MYA2
  ENSP ID: ENSP00000482270

SEQ ID NO: 17146 - protein, 173 aa, Homo sapiens
  Payload ID: 3442
  Gene Symbol: CXorf56
  Gene Name: chromosome X open reading frame 56
  Uniprot ID: Q9H5V9
  ENSP ID: ENSP00000320345
MRPRDRSRVIDAAKHAHKFCNTEDEETMYLRRPEGIERQYRKKCAKCGLPLFYQSQPKNAPVTFIVDGAVVKFGQGFGKTNIYTQKQEPPKKVMMTKRTKDMGKFSSVTVSTIDEEEEEIEAREVADSYAQNAKVIEKQLERKGMSKRRLQELAELEAKKAKMKGTLIDNQFK

SEQ ID NO: 17147 - protein, 208 aa, Homo sapiens
  Payload ID: 3442
  Gene Symbol: CXorf56
  Gene Name: chromosome X open reading frame 56
  Uniprot ID: Q9H5V9
  ENSP ID: ENSP00000441786
MPKVVSRSVVCSDTRDREEYDDGEKPLHVYYCLCGQMVLVLDCQLEKLPMRPRDRSRVIDAAKHAHKFCNTEDEETMYLRRCGLPLFYQSQPKNAPVTFIVDGAVVKFGQGFGKTNIYTQKQEPPKKVMMTKRTKDMGKFSSVTVSTIDEEEEEIEAREVADSYAQNAKVIEKQLERKGMSKRRLQELAELEAKKAKMKGTLIDNQFK

SEQ ID NO: 17148 - protein, 758 aa, Homo sapiens
  Payload ID: 3443
  Gene Symbol: CXorf57
  Gene Name: chromosome X open reading frame 57
  Uniprot ID: Q6NSI4
  ENSP ID: ENSP00000361623
MSGESGQPEAGPSHAGLDWPNPERNRAGVPGGVIRRAGSQGPRSWIQKVLEQIMDSPRQCVTPSEVVPVTVLAVQRYLLEDEPRDTVPKPPLYCYDVTISDGVYQEKCYLDPSLNSLVYQNILKVGIQMRISRVSCLYNEKRIGQGILCIDNVHCGETSDSISLETPFRNRAHQEKPERPLRGGKSHYLALWNNEDPYGDIWLTDKQPEEHNFSDTKIISLSHLEMTWTNRRNFPALLVRILHKSKLRYYGKPDKKMIEPYQTFLEVADSSGTVSVIMWNALCPEWYKSLRVGLVLLLQDYSVKKSYPFRIQPVPVDPQIKLISTMEICLNLRDPPTNIIIIPEKQVKPEWRLPKLNHRFTTRSELDDMPENCICDVIGLLVFVGRVQRSKKKENREDFWSYRWIHIADGTSEQPFIVELFSTSQPEIFENIYPMAYFVCTQLKVVRNDNQVPKLLYLTTTNESGVFITGHRGQPYTYDAKNANRPSTSQAARVEIQERNGKRHQDDEPVNSQYFQTTSTNLSLSNKIRILQGPHANPVAVPQPGASVQTKGIKPGMPSIFNRRANINANLQGKARKTISDRWESQLWREKKFGLIDHLHYSRVYPESIPRKFMFEHRKFLSDQYNSQPAKYVPPEGRPPKLDDFKSARSLGHFEVTILGLNHEIAIDVAFLPMYCPEDIRTSQIDTLLTSMNYSCAYPQDTTGNDRLPGPRAVAGDIIKAATELDRVHIVGILDICNLGNNKVEVYLHKIYSPENTS

SEQ ID NO: 17149 - protein, 855 aa, Homo sapiens
  Payload ID: 3443
  Gene Symbol: CXorf57
  Gene Name: chromosome X open reading frame 57
  Uniprot ID: Q6NSI4
  ENSP ID: ENSP00000361628
MSGESGQPEAGPSHAGLDWPNPERNRAGVPGGVIRRAGSQGPRSWIQKVLEQIMDSPRQCVTPSEVVPVTVLAVQRYLLEDEPRDTVPKPPLYCYDVTISDGVYQEKCYLDPSLNSLVYQNILKVGIQMRISRVSCLYNEKRIGQGILCIDNVHCGETSDSISLETPFRNRAHQEKPERPLRGGKSHYLALWNNEDPYGDIWLTDKQPEEHNFSDTKIISLSHLEMTWTNRRNFPALLVRILHKSKLRYYGKPDKKMIEPYQTFLEVADSSGTVSVIMWNALCPEWYKSLRVGLVLLLQDYSVKKSYPFRIQPVPVDPQIKLISTMEICLNLRDPPTNIIIIPEKQVKPEWRLPKLNHRFTTRSELDDMPENCICDVIGLLVFVGRVQRSKKKENREDFWSYRWIHIADGTSEQPFIVELFSTSQPEIFENIYPMAYFVCTQLKVVRNDNQVPKLLYLTTTNESGVFITGHRGQPYTYDAKVKNFIQWIRTKSDSGEQKNMVIGGYYPYPPVPETFSKYSSSIKVESLLTAISEVRKEIEDLQYREQKRIAIQGIITAIKYIPHSSATESASASETLRNANRPSTSQAARVEIQERNGKRHQDDEPVNSQYFQTTSTNLSLSNKIRILQGPHANPVAVPQPGASVQTKGIKPGMPSIFNRRANINANLQGKARKTISDRWESQLWREKKFGLIDHLHYSRVYPESIPRKFMFEHRKFLSDQYNSQPAKYVPPEGRPPKLDDFKSARSLGHFEVTILGLNHEIAIDVAFLPMYCPEDIRTSQIDTLLTSMNYSCAYPQDTTGNDRLPGPRAVAGDIIKAATELDRVHIVGILDICNLGNNKVEVYLHKIYSPENTS

SEQ ID NO: 17150 - protein, 566 aa, Homo sapiens
  Payload ID: 3443
  Gene Symbol: CXorf57
  Gene Name: chromosome X open reading frame 57
  ENSP ID: ENSP00000405866
NNEDPYGDIWLTDKQPEEHNFSDTKIISLSHLEMTWTNRRNFPALLVRILHKSKLRYYGKPDKKMIEPYQTFLEVADSSGTVSVIMWNALCPEWYKSLRVGLVLLLQDYSVKKSYPFRIQPVPVDPQIKLISTMEICLNLRDPPTNIIIIPEKQVKPEWRLPKLNHRFTTRSELDDMPENCICDVIGLLVFVGRVQRSKKKENREDFWSYRWIHIADGTSEQPFIVELFSTSQPEIFENIYPMAYFVCTQLKVVRNDNQVPKLLYLTTTNESGVFITGHRGQPYTYDAKNANRPSTSQAARVEIQERNGKRHQDDEPVNSQYFQTTSTNLSLSNKIRILQGPHANPVAVPQPGASVQTKGIKPGMPSIFNRRANINANLQGKARKTISDRWESQLWREKKFGLIDHLHYSRVYPESIPRKFMFEHRKFLSDQYNSQPAKYVPPEGRPPKLDDFKSARSLGHFEVTILGLNHEIAIDVAFLPMYCPEDIRTSQIDTLLTSMNYSCAYPQDTTGNDRLPGPRAVAGDIIKAATELDRVHIVGILDICNLGNNKVEVYLHKIYSPENTS

SEQ ID NO: 17151 - protein, 567 aa, Homo sapiens
  Payload ID: 3443
  Gene Symbol: CXorf57
  Gene Name: chromosome X open reading frame 57
  Uniprot ID: Q6NSI4
  ENSP ID: ENSP00000432238
MSGESGQPEAGPSHAGLDWPNPERNRAGVPGGVIRRAGSQGPRSWIQKVLEQIMDSPRQCVTPSEVVPVTVLAVQRYLLEDEPRDTVPKPPLYCYDVTISDGVYQEKCYLDPSLNSLVYQNILKVGIQMRISRVSCLYNEKRIGQGILCIDNVHCGETSDSISLETPFRNRAHQEKPERPLRGGKSHYLALWNNEDPYGDIWLTDKQPEEHNFSDTKIISLSHLEMTWTNRRNFPALLVRILHKSKLRYYGKPDKKMIEPYQTFLEVADSSGTVSVIMWNALCPEWYKSLRVGLVLLLQDYSVKKSYPFRIQPVPVDPQIKLISTMEICLNLRDPPTNIIIIPEKQVKPEWRLPKLNHRFTTRSELDDMPENCICDVIGLLVFVGRVQRSKKKENREDFWSYRWIHIADGTSEQPFIVELFSTSQPEIFENIYPMAYFVCTQLKVVRNDNQVPKLLYLTTTNESGVFITGHRGQPYTYDAKVKNFIQWIRTKSDSGEQKNMVIGGYYPYPPVPETFSKYSSSIKGTNVIASPSKYVYILYVWLMLFQLVIFILFFYGSDLKFSNIHR

SEQ ID NO: 17152 - protein, 332 aa, Homo sapiens
  Payload ID: 3444
  Gene Symbol: CXorf58
  Gene Name: chromosome X open reading frame 58
  Uniprot ID: Q96LI9
  ENSP ID: ENSP00000368511
MNRSSNVPRKGILKSGTRSLQKVRRVHFANARNARSLLSMLKDISAQIIQRAWLSHTNKMIFRLLKHAICAAEFYVTHEILKKVAPLEAKLIKDPTMQCKIRFRFRGETFPPFIVFKIFLHTDGHGYKYFSGKNVLMPSSKAVDDACKLMGERKFHRIIMEDERIFPKSKVTDIMDVVTMQDYVQYRSFFDEAPAFSGGRNNSWRKLNLENIPRTMLMYDIVHYSESGVISNRLRNEMKFLLQRPVTQEIHKHQLRIVSEIRGPYLTVQPLYRPYKQQNQVKFLGRRSKQAQMKVEKMRKVYLAKEKNTSEVTEPKTGPSGTKDNYHLHSIF

SEQ ID NO: 17153 - protein, 126 aa, Homo sapiens
  Payload ID: 3444
  Gene Symbol: CXorf58
  Gene Name: chromosome X open reading frame 58
  ENSP ID: ENSP00000407305
  MOD_RES (1)..(1): Any amino acid
XFANARNARSLLSMLKDISAQIIQRAWLSHTNKMIFRLLKHAICAAEFYVTHEILKKVAPLEAKLIKDPTMQCKIRFRFRGETFPPFIVFKIFLHTDGHGYKYFSGKNVLMPSSKVTFHDVHFMLT

SEQ ID NO: 17154 - protein, 183 aa, Homo sapiens
  Payload ID: 3445
  Gene Symbol: CXorf65
  Gene Name: chromosome X open reading frame 65
  Uniprot ID: A6NEN9
  ENSP ID: ENSP00000363369
MFIFIKHGDNQQFLVNTNCAVVVLLYYIRSKVKLPKTNTIDLCEQTGKMKMLFLMKPNHAEYASKYLTARSTYYVCKVERGPPGTRLENAYRAFVPLLKNPEPWLLVALRIQCDALERRRIQMLKMKEAKKVVIIEPPASVPSKQSGRSDKKKSTRKSPTFRNRPDFRKNKGRQLNKTTKQKK

SEQ ID NO: 17155 - protein, 42 aa, Homo sapiens
  Payload ID: 3445
  Gene Symbol: CXorf65
  Gene Name: chromosome X open reading frame 65
  ENSP ID: ENSP00000411354
MFIFIKHGDNQQFLVNTNCAVVVLLYYIRSKTPSICVNKRGK

SEQ ID NO: 17156 - protein, 361 aa, Homo sapiens
  Payload ID: 3446
  Gene Symbol: CXorf66
  Gene Name: chromosome X open reading frame 66
  Uniprot ID: Q5JRM2
  ENSP ID: ENSP00000359571
MNLVICVLLLSIWKNNCMTTNQTNGSSTTGDKPVESMQTKLNYLRRNLLILVGIIIMVFVFICFCYLHYNCLSDDASKAGMVKKKGIAAKSSKTSFSEAKTASQCSPETQPMLSTADKSSDSSSPERASAQSSTEKLIRPSSLQKPSIPNSAGKLTRPSYPKRSSKSSCSKKLSKSSHLEKAHKKGSLEKLCKLDYACKLASSDKPVRPPQLFKPLYSSHPQNEISPSKPFGPQELAKPPKHFNPKRSVSLGRAALLSNSELAETCQPYKKKHLVAKTYRPLVNDISEAKEKNTQNLHVSSKVKSSSRSFRKLDSRNNAYGDHVNDSDTMKYYSEVDSDKVIIITCDRGYNQVTSEVTLND

SEQ ID NO: 17157 - protein, 503 aa, Homo sapiens
  Payload ID: 3447
  Gene Symbol: CXorf67
  Gene Name: chromosome X open reading frame 67
  Uniprot ID: Q86X51
  ENSP ID: ENSP00000342680
MATQSDMEKEQKHQQDEGQGGLNNETALASGDACGTGNQDPAASVTTVSSQASPSGGAALSSSTAGSSAAAATSAAIFITDEASGLPIIAAVLTERHSDRQDCRSPHEVFGCVVPEGGSQAAVGPQKATGHADEHLAQTKSPGNSRRRKQPCRNQAAPAQKPPGRRLFPEPLPPSSPGFRPSSYPCSGASTSSQATQPGPALLSHASEARPATRSRITLVASALRRRASGPGPVIRGCTAQPGPAFPHRATHLDPARLSPESAPGPARRGRASVPGPARRGCDSAPGPARRGRDSAPVSAPRGRDSAPGSARRGRDSAPGPALRVRTARSDAGHRSTSTTPGTGLRSRSTQQRSALLSRRSLSGSADENPSCGTGSERLAFQSRSGSPDPEVPSRASPPVWHAVRMRASSPSPPGRFFLPIPQQWDESSSSSYASNSSSPSRSPGLSPSSPSPEFLGLRSISTPSPESLRYALMPEFYALSPVPPEEQAEIESTAHPATPPEP

SEQ ID NO: 17158 - protein, 121 aa, Homo sapiens
  Payload ID: 3448
  Gene Symbol: CLLU1
  Gene Name: chronic lymphocytic leukemia up-regulated 1
  Uniprot ID: Q5K131
  ENSP ID: ENSP00000367746
MFNKCSFHSSIYRPAADNSASSLCAIICFLNLVIECDLETNSEINKLIIYLFSQNNRIRFSKLLLKILFYISIFSYPELMCEQYVTFIKPGIHYGQVSKKHIIYSTFLSKNFKFQLLRVCW

SEQ ID NO: 17159 - protein, 101 aa, Homo sapiens
  Payload ID: 3449
  Gene Symbol: CLLU1OS
  Gene Name: chronic lymphocytic leukemia up-regulated 1 opposite strand
  Uniprot ID: Q5K130
  ENSP ID: ENSP00000367748
MNKLGHNELKECLKTATDSLQTVQPSISQTCTSYGPALGAPLPGRNEVALLTSLPPNYEISEGKPRAISAYVRAGKGNVTRRRKKTHLGNDDGKKEAQEKM

SEQ ID NO: 17160 - protein, 471 aa, Homo sapiens
  Payload ID: 3450
  Gene Symbol: CHURC1-FNTB
  Gene Name: CHURC1-FNTB readthrough
  ENSP ID: ENSP00000447121
MCGDCVEKEYPNRGNTCLENGSFLLNFTGCAVCSKRDFMLITNKSLKEEDGEEIVTYDHLCKNCHHVIARHEYTFSIMDEFQAKVEEKIQEVFSSYKFNHLVPRLVLQREKHFHYLKRGLRQLTDAYECLDASRPWLCYWILHSLELLDEPIPQIVATDVCQFLELCQSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 17161 - protein, 107 aa, Homo sapiens
  Payload ID: 3450
  Gene Symbol: CHURC1-FNTB
  Gene Name: CHURC1-FNTB readthrough
  ENSP ID: ENSP00000449668
  MOD_RES (1)..(1): Any amino acid
XCVAMCGDCVEKEYPNRGNTCLENGSFLLNFTGCAVCSKRDFMLITNKSLKEEDGEEIVTYDRKSRRKDPRGLQFLQVQPPCTKACFAEGEALPLSEKRPSTTDRCL

SEQ ID NO: 17162 - protein, 85 aa, Homo sapiens
  Payload ID: 3450
  Gene Symbol: CHURC1-FNTB
  Gene Name: CHURC1-FNTB readthrough
  ENSP ID: ENSP00000449709
GCAVCSKRDFMLITNKSLKEEDGEEIVTYDPDLCKNCHHVIARHEYTFSIMDEFQEYTMLCLLCGKAEDTISILPDDPRQMTLLF

SEQ ID NO: 17163 - protein, 69 aa, Homo sapiens
  Payload ID: 3450
  Gene Symbol: CHURC1-FNTB
  Gene Name: CHURC1-FNTB readthrough
  ENSP ID: ENSP00000450692
GCAVCSKRDFMLITNKSLKEEDGEEIVTYDRKSRRKDPRGLQFLQVQPPCTKCLDASRPWLCYWILHSL

SEQ ID NO: 17164 - protein, 108 aa, Homo sapiens
  Payload ID: 3451
  Gene Symbol: CHURC1
  Gene Name: churchill domain containing 1
  ENSP ID: ENSP00000352026
MCGDCVEKEYPNRGNTCLENGSFLLNFTGCAVCSKRDFMLITNKSLKEEDGEEIVTYDPDLCKNCHHVIARHEYTFSIMDEFQEYTMLCLLCAKPKILSVFSLMTPDK

SEQ ID NO: 17165 - protein, 126 aa, Homo sapiens
  Payload ID: 3451
  Gene Symbol: CHURC1
  Gene Name: churchill domain containing 1
  ENSP ID: ENSP00000446610
  MOD_RES (1)..(1): Any amino acid
XPVDCVAMCGDCVEKEYPNRGNTCLENGSFLLNFTGCAVCSKRDFMLITNKSLKEEDGEEIVTYDHLCKNCHHVIARHEYTFSIMDEFQDKIKGTLRRRVCHFLGEKRSFQCLSSCQAEETKLCLS

SEQ ID NO: 17166 - protein, 83 aa, Homo sapiens
  Payload ID: 3451
  Gene Symbol: CHURC1
  Gene Name: churchill domain containing 1
  ENSP ID: ENSP00000446697
  MOD_RES (1)..(1): Any amino acid
XVSSSRKRWRTFPVDCVAMCGDCVEKEYPNRGNTCLENGSFLLNFTGCAVCSKRDFMLITNKSLKEEDGEEIVTYDRQNQRDP

SEQ ID NO: 17167 - protein, 139 aa, Homo sapiens
  Payload ID: 3451
  Gene Symbol: CHURC1
  Gene Name: churchill domain containing 1
  Uniprot ID: Q8WUH1
  ENSP ID: ENSP00000448050
MRQPYLSSREVSSSRKRWRTFPVDCVAMCGDCVEKEYPNRGNTCLENGSFLLNFTGCAVCSKRDFMLITNKSLKEEDGEEIVTYDHLCKNCHHVIARHEYTFSIMDEFQEYTMLCLLCGKAEDTISILPDDPRQMTLLF

SEQ ID NO: 17168 - protein, 95 aa, Homo sapiens
  Payload ID: 3451
  Gene Symbol: CHURC1
  Gene Name: churchill domain containing 1
  ENSP ID: ENSP00000449184
  MOD_RES (1)..(1): Any amino acid
XGSFLLNFTGCAVCSKRDFMLITNKSLKEEDGEEIVTYDHLCKNCHHVIARHEYTFSIMDEFQVAIQIAMPGGLKQWKYLRTVKDLEEDVFLFYF

SEQ ID NO: 17169 - protein, 112 aa, Homo sapiens
  Payload ID: 3451
  Gene Symbol: CHURC1
  Gene Name: churchill domain containing 1
  ENSP ID: ENSP00000450144
MCGDCVEKEYPNRGNTCLENGSFLLNFTGCAVCSKRDFMLITNKSLKEEDGEEIVTYDHLCKNCHHVIARHEYTFSIMDEFQEYTMLCLLCGKAEDTISILPDDPRQMTLLF

SEQ ID NO: 17170 - protein, 105 aa, Homo sapiens
  Payload ID: 3451
  Gene Symbol: CHURC1
  Gene Name: churchill domain containing 1
  Uniprot ID: Q8WUH1
  ENSP ID: ENSP00000450165
MRQPYLSSREVSSSRKRWRTFPVDCVAMCGDCVEKEYPNRGNTCLENGSFLLNFTGCAVCSKRDFMLITNKSLKEEDGEEIVTYDRVYHAVSVMRQSRRYYQYSP

SEQ ID NO: 17171 - protein, 140 aa, Homo sapiens
  Payload ID: 3451
  Gene Symbol: CHURC1
  Gene Name: churchill domain containing 1
  Uniprot ID: Q8WUH1
  ENSP ID: ENSP00000475473
MRQPYLSSREVSSSRKRWRTFPVDCVAMCGDCVEKEYPNRGNTCLENGSFLLNFTGCAVCSKRDFMLITNKSLKEEDGEEIVTYDPDLCKNCHHVIARHEYTFSIMDEFQEYTMLCLLCGKAEDTISILPDDPRQMTLLF

SEQ ID NO: 17172 - protein, 136 aa, Homo sapiens
  Payload ID: 3452
  Gene Symbol: CMA1
  Gene Name: chymase 1, mast cell
  Uniprot ID: P23946
  ENSP ID: ENSP00000206446
MLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 17173 - protein, 247 aa, Homo sapiens
  Payload ID: 3452
  Gene Symbol: CMA1
  Gene Name: chymase 1, mast cell
  Uniprot ID: P23946
  ENSP ID: ENSP00000250378
MLLLPLPLLLFLLCSRAEAGEIIGGTECKPHSRPYMAYLEIVTSNGPSKFCGGFLIRRNFVLTAAHCAGRSITVTLGAHNITEEEDTWQKLEVIKQFRHPKYNTSTLHHDIMLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 17174 - protein, 69 aa, Homo sapiens
  Payload ID: 3453
  Gene Symbol: CTRC
  Gene Name: chymotrypsin C (caldecrin)
  ENSP ID: ENSP00000365110
MLGITVLAALLACATPGPTVWPWERTTWRWKTKKDPCLWVWTPSTSTRDGMPSCCAMILPSSSLQSMWS

SEQ ID NO: 17175 - protein, 268 aa, Homo sapiens [sequence omitted]

SEQ ID NO: 17176 - protein, 264 aa, Homo sapiens
  Payload ID: 3454
  Gene Symbol: CTRL
  Gene Name: chymotrypsin-like
  Uniprot ID: P40313
  ENSP ID: ENSP00000458537
MLLLSLTLSLVLLGSSWGCGIPAIKPALSFSQRIVNGENAVLGSWPWQVSLQDSSGFHFCGGSLISQSWVVTAAHCNVSPGRHFVVLGEYDRSSNAEPLQVLSVSRAITHPSWNSTTMNNDVTLLKLASPAQYTTRISPVCLASSNEALTEGLTCVTTGWGRLSGVGNVTPAHLQQVALPLVTVNQCRQYWGSSITDSMICAGGAGASSCQGDSGGPLVCQKGNTWVLIGIVSWGTKNCNVRAPAVYTRVSKFSTWINQVIAYN

SEQ ID NO: 17177 - protein, 190 aa, Homo sapiens
  Payload ID: 3454
  Gene Symbol: CTRL
  Gene Name: chymotrypsin-like
  ENSP ID: ENSP00000458598
MLLLSLTLSLVLLGSSWGQQRLPLLRWFSHQPVLGGHCCPLQCQVLSVSRVSAWAADTEEKWAVQAITHPSWNSTTMNNDVTLLKLASPAQYTTRISPVCLASSNEALTEGLTCVTTGWGRLSGVGNVTPAHLQQVALPLVTVNQCRQYWGSSITDSMICAGGAGASSCQGDSGGPLVCQKGNTWVLIGI

SEQ ID NO: 17178 - protein, 190 aa, Homo sapiens
  Payload ID: 3454
  Gene Symbol: CTRL
  Gene Name: chymotrypsin-like
  ENSP ID: ENSP00000461842
MLLLSLTLSLVLLGSSWGCGIPAIKPALSFSQRIVNGENAVLGSWPWQVSLQDSSGFHFCGGSLISQSWVVTAAHCNVSPGRHFVVLGEYDRSSNAEPLQVLSVSRAITHPSWNSTTMNNDVTLLKLASPAQYTTRISPVCLASSNEALLSARRETHGCLLVLSPGAPKTAMCAHLLCILELASSAPGST

SEQ ID NO: 17179 - protein, 258 aa, Homo sapiens
  Payload ID: 3455
  Gene Symbol: CELA1
  Gene Name: chymotrypsin-like elastase family, member 1
  Uniprot ID: Q9UNI1
  ENSP ID: ENSP00000293636
MLVLYGHSTQDLPETNARVVGGTEAGRNSWPSQISLQYRSGGSRYHTCGGTLIRQNWVMTAAHCVDYQKTFRVVAGDHNLSQNDGTEQYVSVQKIVVHPYWNSDNVAAGYDIALLRLAQSVTLNSYVQLGVLPQEGAILANNSPCYITGWGKTKTNGQLAQTLQQAYLPSVDYAICSSSSYWGSTVKNTMVCAGGDGVRSGCQGDSGGPLHCLVNGKYSVHGVTSFVSSRGCNVSRKPTVFTQVSAYISWINNVIASN

SEQ ID NO: 17180 - protein, 269 aa, Homo sapiens
  Payload ID: 3456
  Gene Symbol: CELA2A
  Gene Name: chymotrypsin-like elastase family, member 2A
  Uniprot ID: P08217
  ENSP ID: ENSP00000352639
MIRTLLLSTLVAGALSCGDPTYPPYVTRVVGGEEARPNSWPWQVSLQYSSNGKWYHTCGGSLIANSWVLTAAHCISSSRTYRVGLGRHNLYVAESGSLAVSVSKIVVHKDWNSNQISKGNDIALLKLANPVSLTDKIQLACLPPAGTILPNNYPCYVTGWGRLQTNGAVPDVLQQGRLLVVDYATCSSSAWWGSSVKTSMICAGGDGVISSCNGDSGGPLNCQASDGRWQVHGIVSFGSRLGCNYYHKPSVFTRVSNYIDWINSVIANN

SEQ ID NO: 17181 - protein, 269 aa, Homo sapiens
  Payload ID: 3457
  Gene Symbol: CELA2B
  Gene Name: chymotrypsin-like elastase family, member 2B
  Uniprot ID: P08218
  ENSP ID: ENSP00000365075
MIRTLLLSTLVAGALSCGVSTYAPDMSRMLGGEEARPNSWPWQVSLQYSSNGQWYHTCGGSLIANSWVLTAAHCISSSGIYRVMLGQHNLYVAESGSLAVSVSKIVVHKDWNSDQVSKGNDIALLKLANPVSLTDKIQLACLPPAGTILPNNYPCYVTGWGRLQTNGALPDDLKQGQLLVVDYATCSSSGWWGSTVKTNMICAGGDGVICTCNGDSGGPLNCQASDGRWEVHGIGSLTSVLGCNYYYKPSIFTRVSNYNDWINSVIANN

SEQ ID NO: 17182 - protein, 125 aa, Homo sapiens
  Payload ID: 3457
  Gene Symbol: CELA2B
  Gene Name: chymotrypsin-like elastase family, member 2B
  ENSP ID: ENSP00000399811
CGVSTYAPDMSRMLGGEEARPNSWPWQVSLQYSSNGQWYHTCGGSLIANSWVLTAAHCIRQIIKAHKVLQRCSLILFFVRDLCSSQLELTGVSAGSSGIYRVMLGQHNLYVAESGSLAVSVSKIV

SEQ ID NO: 17183 - protein, 270 aa, Homo sapiens
  Payload ID: 3458
  Gene Symbol: CELA3A
  Gene Name: chymotrypsin-like elastase family, member 3A
  Uniprot ID: P09093
  ENSP ID: ENSP00000290122
MMLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACGNDIALIKLSRSAQLGDAVQLASLPPAGDILPNKTPCYITGWGRLYTNGPLPDKLQQARLPVVDYKHCSRWNWWGSTVKKTMVCAGGYIRSGCNGDSGGPLNCPTEDGGWQVHGVTSFVSAFGCNFIWKPTVFTRVSAFIDWIEETIASH

SEQ ID NO: 17184 - protein, 121 aa, Homo sapiens
  Payload ID: 3458
  Gene Symbol: CELA3A
  Gene Name: chymotrypsin-like elastase family, member 3A
  ENSP ID: ENSP00000363795
MMLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACG

SEQ ID NO: 17185 - protein, 75 aa, Homo sapiens
  Payload ID: 3458
  Gene Symbol: CELA3A
  Gene Name: chymotrypsin-like elastase family, member 3A
  ENSP ID: ENSP00000383130
WWGSTVKKTMVCAGGYIRSGCNGDSGGPLNCPTEDGGWQVHGVTSFVSAFGCNFIWKPTVFTRVSAFIDWIEEGG

SEQ ID NO: 17186 - protein, 270 aa, Homo sapiens
  Payload ID: 3459
  Gene Symbol: CELA3B
  Gene Name: chymotrypsin-like elastase family, member 3B
  Uniprot ID: P08861
  ENSP ID: ENSP00000338369
MMLRLLSSLLLVAVASGYGPPSSRPSSRVVNGEDAVPYSWPWQVSLQYEKSGSFYHTCGGSLIAPDWVVTAGHCISSSRTYQVVLGEYDRAVKEGPEQVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEETIASH

SEQ ID NO: 17187 - protein, 164 aa, Homo sapiens
  Payload ID: 3459
  Gene Symbol: CELA3B
  Gene Name: chymotrypsin-like elastase family, member 3B
  ENSP ID: ENSP00000363798
MRSCYVAQAGLKLPGSSDPPASASQSTRITASGYGPPSSRPSSRVVNGEDAVPYSWPWQVSLQYEKSGSFYHTCGGSLIAPDWVVTAGHCISSSRTYQVVLGEYDRAVKEGPEQVIPINSGDLFVHPLWNRSCVACGNDIALIKLSRSAQLGDAVQLASLPPAG

SEQ ID NO: 17188 - protein, 180 aa, Homo sapiens
  Payload ID: 3459
  Gene Symbol: CELA3B
  Gene Name: chymotrypsin-like elastase family, member 3B
  ENSP ID: ENSP00000383135
QVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEEKLQGNKAPESRT

SEQ ID NO: 17189 - protein, 263 aa, Homo sapiens
  Payload ID: 3460
  Gene Symbol: CTRB1
  Gene Name: chymotrypsinogen B1
  Uniprot ID: P17538
  ENSP ID: ENSP00000354294
MASLWLLSCFSLVGAAFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSDTCSTSSPGVYARVTKLIPWVQKILAAN

SEQ ID NO: 17190 - protein, 182 aa, Homo sapiens
  Payload ID: 3460
  Gene Symbol: CTRB1
  Gene Name: chymotrypsinogen B1
  ENSP ID: ENSP00000463301
MCQGGPELASVDWGRTGRAARRQVRPRWVWGLSPYSPHSPPGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTG

SEQ ID NO: 17191 - protein, 263 aa, Homo sapiens
  Payload ID: 3461
  Gene Symbol: CTRB2
  Gene Name: chymotrypsinogen B2
  Uniprot ID: Q6GPI1
  ENSP ID: ENSP00000303963
MAFLWLLSCWALLGTTFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSRTCSTTTPAVYARVAKLIPWVQKILAAN

SEQ ID NO: 17192 - protein, 168 aa, Homo sapiens
  Payload ID: 3461
  Gene Symbol: CTRB2
  Gene Name: chymotrypsinogen B2
  ENSP ID: ENSP00000454599
EFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGGDSGGPLVCQKDGAWTLVGIVSWGSRTCSTTTPAVYARVAKLIPWVQKILAAN

SEQ ID NO: 17193 - protein, 137 aa, Homo sapiens
  Payload ID: 3461
  Gene Symbol: CTRB2
  Gene Name: chymotrypsinogen B2
  ENSP ID: ENSP00000455207
VAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMVRLALPRPWPG

SEQ ID NO: 17194 - protein, 114 aa, Homo sapiens
  Payload ID: 3461
  Gene Symbol: CTRB2
  Gene Name: chymotrypsinogen B2
  ENSP ID: ENSP00000457279
DKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNG

SEQ ID NO: 17195 - protein, 3096 aa, Homo sapiens
  Payload ID: 3462
  Gene Symbol: CFAP54
  Gene Name: cilia and flagella associated 54
  Uniprot ID: Q96N23
  ENSP ID: ENSP00000431759
MAAQGSPSSSPSDDSTTSGSLPELPPTSTATSRSPPESKGSSRSSLLQWTCPEDSLPLAVFYGPLDAKNPLLASCEKEIQELLGFMRKKKALATTEEEKHEFRRRCATSLFNIWTKYAPRLPADYYNEKLLKVGDSLCQMKEYKLALLQCYGRYLQQFNTNFDENKVDVTQFKATFFPKGFKDKTAGLTFHALSGKNMCNYQLVCDSDENLKNKESVVQCLHILSSLRLIMQVALPQEHLCWIIFNGTIYIYTICRKLMVIGQSSKALEYLLWASMCMESLVPLLSLRYLTWRATLYTAVCQCCYDCHAGIHGEAFARRALAKIDELRQLELMSSSKSQEESRRYFREATMKMAVMIFKRGVFESRRKNKAVFRPKIRINLREVQTLSWPRTVTERLLDEMFDSTASQFLAVLEALSDSNRRILQTGPIVTDEVEIHDVVSELFMAGKELLIMSNIGADGMLDFPKTSLLELMIGRKDVISVDAAVKFIKLAFTYEEWSLFESSAVHLIYFLQRQDDPESKKAEKDLTLLIAMEPLINVKRNKGLIFPLENYKEGQSTQIYLKKIAVHDTCLKTCGYSEDIFHLAATLYVCVCTAPQDVQPDKEIVVDTIMFLWQKCKLGIQRLNISRNDYAKFTQKISTNKWIYLLWQINEVIHCYKMEDIDIVVVAEVTLRLSEILESLGSPGRKFKQSLDVPLREGTNKFPGAPKGITEILPILQKNPVEQLLFAYKLLDRAIGGINLNCMLTSLPNGSSVIDHCYAKRTHHIDGDTYKPLASNSFMMDLHLELIQAQHRIAVVLLDKLQVLQTPTVSKDISTKGPEKLKQSGSTDCFTELNIMNKIKKNTLSKAIYLMQKALLIFEKDATSTSSWELLMEAYSLIQRIEAEQNALYSYQKYLESSKRKKSRVPPPPILLSRTHCSVTLKPAPFTSEVKVSWYCILGCKAEGSYGKVRLNNNHLPNSGEAIPADGKSVFEVKGLETNEKYVFAVAAYSNNGKLVGGAIGETTKPILVYPPLSTITARMFLTQVAYQVGNYELAKKVFSPVWDYFVASPLQDEQSVICLSNIITITQRRLHSDILAETSSILLYLFLRNIFVTSDIKIKEENLFCDNIKGNEIFPSQQIARLIECERVLVALELSNFLNDSSYALQAVTQCYGLLAPIIYHNIVLVPVVQILIKCIVVLQGLPSIVCSKKHTASFESIQHMIACCIFYITKILRSWREYDLAVMIINYGKKMLDITPGCKSLFDGSNEQEEMPEEDSSKKSLKTKKPQQILLPEKINEQLALLETHLLKLTKQYVTSELSGGEDPIFLYPVVLNWSVKGAVKEVMKFKQKPRFLEFFTQVMLKCMNEEKFHLMVEVTTPVHDFLKRRNESLLGLIKVKYKDSALNKKANKSLKFKAAVMEIGRSAEMQQRIRSKKKETLRDFIFKNPAISEMVAHERNRRTSVRKAAQRYLMDYLNPLILSYVKRKRFHRLSLEEMPWRAQMNLYLAGAHFNLVLQKLWECTKMKFGTSHMMVSFRSCDPNMFSLYNSGTVLPTRKLTVENYKAMLDFLLTAKKRKANLPSDAEEFSTFINSIMSDENMSKTQTVYDSDSQSGSSAKEKDRGANLCVMDHFMKIFLYCRRAMVLAHRGGYWTLLQNCCRALWNFTQELQILLKQAVDLDKTFPISQDGFLCTSVLPFYLGAELLIDMLIQLQNTSSIKPIEDKGEFSVPSCYGNIKNDNGGSSLTFEHPLDDVNVVDLKWIHDFVLKSLEVLYQVEKWETLVSLAIQFNTVSHERYTEQVTPLLVYAQRQLLLRIQKFKGPDITQQPCARYEAEYGEKITCRNFIGKQLKINSSTIEATSNCTDLLKMLISSEYSRAKALVCVPVDVTDTLRCFRETLEKSKYHNRSIRHSRKLLSLFLAQTQDVLQASNQRSLKVQALHSLGSLLIFAEKKRAAFKCWCQALDDIFRKPDVLHTWKEFGPSLTNVTNSHSPPGFKDYSEEFLSRVGIWGCLQGAVISAKIAQFIKSLNVEKKTDCCILSALLFQGLLRTTLPHPKAERCYAQYEITQLLPGIELFSDRYRADICSVIASLYYIIRELHFVRQNLIVLPLLALYQYFVSGICQDITRNLEARILKIEVLIDLRFFSEAFYEISQIFYGKNMPCPIPAGYKATGKMKIFQSFDSGKLLTSKENIQAIDELRNKGLPAVLVTIGQPHLLNKFNFVKAYFFLSVAATINCVPENKFKTVITNKSKPNLPNLEEIYSKDDGSSFYNLTKLKDEITLSMLKSMLLMEAEDRLNFLLSEVEQKTLSQCSAGELEIVVEARLQLAAVALQRHRAAYSAAIVFSTLTLLQDSKLFEKKVVQDDTENPVSPGTSVTENKDDSEFLDPISLNAREYFNIHLWLRCRLALVTAFVAQIHGIGIVKEDDMTDCLSLINEVCMEAKSAGDTELQAEFLTQAVILGLQEKHLKADIMTNLQDIIHLLEGNEFISPQSRLTLARSLVLLDDLTKAEKFKESPSSKTGKLNLLTRAHSILTEQMLAFGETIEFRSSNTKYANPLQPLKNIYLPHVMLLAKIKMRIGHTVAKQVYYKNKRKDPSKWLPALHLFDVALKLCRTTAVEEHEVEAEILFQKGKIERQILMEEKSPSFQLESLYEAIQLSLKNDQNSGLIRDSYLEMALLYFHLKKPKIKISGSPLTLKPPLRRSSSVKETSANKFEMYSSLAWIAIRAAAQVSEAVLAINLLIGKKNTRMHKVNQVALPNIPEFAALDLLSSYTDYLLDNYQVLFQTSCTFLYQNDDVCDSADGRKKTQTKVDITWILLLRYYIHLQRINNLSKLLASATPVSGISLPDDTLLTSLYNSELILRQKEVHFFLKKFLQLYSSSCIDEFPKELLCQLENPPLSEKDLRESSAKLYRDSSVQSILSFKPVSGSSCVDITPIEMVTQASNKELCFQWYIPPLDRPPKETEPMVLLLYAYNLKPLKISDVRHSTYNSTCVGSLWIPLNRVIAIHEKLSNLAQIAELSLPAAPEITSNENIYEVEVEEESVDNEMEDMIIQCCSEIASLFLNDKEPTPLSEVPFDISLPSIFNLERLFDLANGCILSGGSLFNWIVSIIP

SEQ ID NO: 17196 - protein, 265 aa, Homo sapiens
  Payload ID: 3462
  Gene Symbol: CFAP54
  Gene Name: cilia and flagella associated 54
  ENSP ID: ENSP00000449035
  MOD_RES (1)..(1): Any amino acid
XPEEDSSKKSLKTKKPQQILLPEKINEQLALLETHLLKLTKQYVTSELSGGEDPIFLYPVVLNWSVKGAVKEVMKFKQKPRFLEFFTQVMLKCMNEEKFHLMVEVTTPVHDFLKRRNESLLGLIKVKYKDSALNKKANKSLKFKAAVMEIGRSAEMQQRIRSKKKETLRDFIFKNPAISEMVAHERNRRTSVRKAAQRYLMDYLNPLILSYVKRKRFHRLSLEEMPWRAQMNLYLAGAHFNLVLQKLWECTKMKFGTSHMMVRHF

SEQ ID NO: 17197 - protein, 644 aa, Homo sapiens
  Payload ID: 3462
  Gene Symbol: CFAP54
  Gene Name: cilia and flagella associated 54
  ENSP ID: ENSP00000452066
MAAQGSPSSSPSDDSTTSGSLPELPPTSTATSRSPPESKGSSRSSLLQWTCPEDSLPLAVFYGPLDAKNPLLASCEKEIQELLGFMRKKKALATTEEEKHEFRRRCATSLFNIWTKYAPRLPADYYNEKLLKVGDSLCQMKFHALSGKNMCNYQLVCDSDENLKNKESVVQCLHILSSLRLIMQVALPQEHLCWIIFNGTIYIYTICRKLMVIGQSSKALEYLLWASMCMESLVPLLSLRYLTWRATLYTAVCQCCYDCHAGIHGEAFARRALAKIDELRQLELMSSSKSQEESRRYFREATMKMAVMIFKRGVFESRRKNKAVFRPKIRINLREVQTLSWPRTVTERLLDEMFDSTASQFLAVLEALSDSNRRILQTGPIVTDEVEIHDVVSELFMAGKELLIMSNIGADGMLDFPKTSLLELMIGRKDVISVDAAVKFIKLAFTYEEWSLFESSAVHLIYFLQRQDDPESKKAEKDLTLLIAMEPLINVKRNKGLIFPLENYKEGQSTQIYLKKIAVHDTCLKTCGYSEDIFHLAATLYVCVCTAPQDVQPDKEIVVDTIMFLWQKCKLGIQRLNISRNDYAKFTQKISTNKVFLSHSLSRVFFAIAYSSCHTHFKSKFFLFFTWLMTFICIYTYIKKIFFL

SEQ ID NO: 17198 - protein, 611 aa, Homo sapiens
  Payload ID: 3463
  Gene Symbol: CFAP100
  Gene Name: cilia and flagella associated protein 100
  Uniprot ID: Q494V2
  ENSP ID: ENSP00000344749
MSEIPSTIVSKNMTNDKNSLESMNISSSSSTEENPKKQARKNEEHGPDPSANPFHLSGDVDFFLLRDQERNKALSERQQQKTMRVHQKMTYSSKVSAKHTSLRRQLQLEDKQEDLEARAEAEHQRAFRDYTTWKLTLTKEKNVEPENMSGYIKQKRQMFLLQYALDVKRREIQRLETLATKEEARLERAEKSLEKDAALFDEFVRENDCSSVQAMRAAEKETKAKIEKILEIRDLTTQIVNIKSEISRFEDTLKHYKVYKDFLYKLSPKEWLEEQEKKHSFLKKAKEVSEASKESSVNSTPGDKGPGIKGKASSMWAKEGQGTKKPWRFLQTMRLGRSPSYLSSPQQGSQPSESSGGDSRGSNSPIPPTQEDTDSDGEEPQLYFTEPQQLLDVFRELEEQNLSLIQNSQETEKTLEELSHTLKHTQIRMDREVNQLKQWVTTMMMSITKEEDTAAELELKARVFHFGEYKGDQQDKLLESLNCKVLDVYRHCTGTQQEANLGTVQMLTIIEHQLDELLENLEHVPQVKIEQAERAKEKERRIRLREEKLQMQKILQEEHLQRARARAQAEIKKKRGRTLVCRSRPPAHRIKQQSEHTLMDKEEEELLFFFT

SEQ ID NO: 17199 - protein, 612 aa, Homo sapiens
  Payload ID: 3463
  Gene Symbol: CFAP100
  Gene Name: cilia and flagella associated protein 100
  Uniprot ID: Q494V2
  ENSP ID: ENSP00000423046
MSEIPSTIVSKNMTNDKNSLESMNISSSSSTEENPKKQARKNEEHGPDPSANPFHLSGDVDFFLLRDQERNKALSERQQQKTMRVHQKMTYSSKVSAKHTSLRRQLQLEDKQEDLEARAEAEHQRAFRDYTTWKLTLTKAEKNVEPENMSGYIKQKRQMFLLQYALDVKRREIQRLETLATKEEARLERAEKSLEKDAALFDEFVRENDCSSVQAMRAAEKETKAKIEKILEIRDLTTQIVNIKSEISRFEDTLKHYKVYKDFLYKLSPKEWLEEQEKKHSFLKKAKEVSEASKESSVNSTPGDKGPGIKGKASSMWAKEGQGTKKPWRFLQTMRLGRSPSYLSSPQQGSQPSESSGGDSRGSNSPIPPTQEDTDSDGEEPQLYFTEPQQLLDVFRELEEQNLSLIQNSQETEKTLEELSHTLKHTQIRMDREVNQLKQWVTTMMMSITKEEDTAAELELKARVFHFGEYKGDQQDKLLESLNCKVLDVYRHCTGTQQEANLGTVQMLTIIEHQLDELLENLEHVPQVKIEQAERAKEKERRIRLREEKLQMQKILQEEHLQRARARAQAEIKKKRGRTLVCRSRPPAHRIKQQSEHTLMDKEEEELLFFFT

SEQ ID NO: 17200 - protein, 117 aa, Homo sapiens
  Payload ID: 3463
  Gene Symbol: CFAP100
  Gene Name: cilia and flagella associated protein 100
  ENSP ID: ENSP00000432494
MSEIPSTIVSKNMTNDKNSLESMNISSSSSTEENPKKQARKNEEHGPDPSANPFHLSGDVDFFLLRDQERNKALSVSIQDRRQHLRELPCSHCFLEWPHCPSQRSTFLRSFSFQNSQ

SEQ ID NO: 17201 - protein, 177 aa, Homo sapiens
  Payload ID: 3464
  Gene Symbol: CFAP126
  Gene Name: cilia and flagella associated protein 126
  Uniprot ID: Q5VTH2
  ENSP ID: ENSP00000356951
MATNYSANQYEKAFSSKYLQNWSPTKPTKESISSHEGYTQIIANDRGHLLPSVPRSKANPWGSFMGTWQMPLKIPPARVTLTSRTTAGAASLTKWIQKNPDLLKASNGLCPEILGKPHDPDSQKKLRKKSITKTVQQARSPTIIPSSPAANLNSPDELQSSHPSAGHTPGPQRPAKS

SEQ ID NO: 17202 - protein, 520 aa, Homo sapiens
  Payload ID: 3465
  Gene Symbol: CFAP157
  Gene Name: cilia and flagella associated protein 157
  Uniprot ID: Q5JU67
  ENSP ID: ENSP00000362392
MAPKKSVSKAGKELEVKKKGGKKEPVVAVEPPLAKEMKEFYHIQIRDLEDRLARYQRKWDELAVQEKMFRQEFEQLANNKKEIVAFLKRTLNQQVDEITDLNEQLQNLQLAKEMEKDAFEAQLAQVRHEFQETKDQLTTENIILGGKLAALEEFRLQKEEVTDKFTLLEEQVRKQENEFRDYAYNLEKKSVLDKDRLRKEIIQRVNLVANEFHKVTTNRMWETTKRAIKENNGITLQMARVSQQGMKLLQENEQLKGRQNNLCKQLELLENTQKVMARHKRGHQKIILMLTKKCQEQQQDTKEAEELRLLLSQLEQRSLQLQVDNQALKSQRDQLSLQLEQQQVDLQRLQQELANEQKVRASLEAALVQATSFLQNILQMHRDEEDSDVDVTFQPWHKEMLQQLLVMLSSTVATRPQKAACPHQESQSHGPPKESRPSIQLPRTGSLLPQLSDITPYQPGDLGLVPRQVHIPPNPQDLRLLSYITRVGTFRAHSSPEMRAPGSLKRLEKFSLPEVPLRPK

SEQ ID NO: 17203 - protein, 425 aa, Homo sapiens
  Payload ID: 3465
  Gene Symbol: CFAP157
  Gene Name: cilia and flagella associated protein 157
  Uniprot ID: Q5JU67
  ENSP ID: ENSP00000478313
MAPKKSVSKAGKELEVKKKGGKKEPVVAVEPPLAKEMKEFYHIQIRDLEDRLARYQRKWDELAVQEKMFRQEFEQLANNKKEIVAFLKRTLNQQVDEITDLNEQLQNLQLAKEMEKDAFEAQLAQVRHEFQETKDQLTTENIILGGKLAALEEFRLQKEEVTDKFTLLEEQVRKQENEFRDYAYNLEKKSVLDKDRLRKEIIQRVNLVANEFHKVTTNRMWETTKRAIKENNGITLQMARVSQQGMKLLQENEQLKGRQNNLCKQLELLENTQKVMARHKRGHQKIILMLTKKCQEQQQDTKEAEELRLLLSQLEQRSLQLQVDNQALKSQRDQLSLQLEQQQVDLQRLQQELANEQKVRASLEAALVQATSFLQNILQTGKTSWKWALRLEFPGRGWVLGPLWACCHPTLTNRCTAMKRTVTLT

SEQ ID NO: 17204 - protein, 137 aa, Homo sapiens
  Payload ID: 3465
  Gene Symbol: CFAP157
  Gene Name: cilia and flagella associated protein 157
  ENSP ID: ENSP00000485445
  MOD_RES (1)..(1): Any amino acid
XDVTFQPWHKEMLQQLLVMLSSTVATRPQKAACPHQESQSHGPPKESRPSIQLPRTGSLLPQLSDITPYQPGDLGLVPRQVHIPPNPQDLRLLSYITRVGTFRAHSSPERPVGPNAEERKRRATLQWGRGAKKGPRN

SEQ ID NO: 17205 - protein, 301 aa, Homo sapiens
  Payload ID: 3466
  Gene Symbol: CFAP161
  Gene Name: cilia and flagella associated protein 161
  Uniprot ID: Q6P656
  ENSP ID: ENSP00000286732
MAQNVYGPGVRIGNWNEDVYLEEELMKDFLEKRDKGKLLIQRSRRLKQNLLRPMQLSVTEDGYIHYGDKVMLVNPDDPDTEADVFLRGDLSLCMTPDEIQSHLKDELEVPCGLSAVQAKTPIGRNTFIILSVHRDATGQVLRYGQDFCLGITGGFDNKMLYLSSDHRTLLKSSKRSWLQEVYLTDEVSHVNCWQAAFPDPQLRLEYEGFPVPANAKILINHCHTNRGLAAHRHLFLSTYFGKEAEVVAHTYLDSHRVEKPRNHWMLVTGNPRDASSSMLDLPKPPTEDTRAMEQAMGLDTQ

SEQ ID NO: 17206 - protein, 111 aa, Homo sapiens
  Payload ID: 3466
  Gene Symbol: CFAP161
  Gene Name: cilia and flagella associated protein 161
  ENSP ID: ENSP00000453414
MKDFLEKRDKGKLLIQRSRRLKQNLLRPMQLSVTEDGYIHYGDKVMLVNPDDPDTEADVFLRGDLSLCMTPDEIQSHLKDELEVPCGLSAVQAKTPIGRNTFIILSVHRDA

SEQ ID NO: 17207 - protein, 105 aa, Homo sapiens
  Payload ID: 3466
  Gene Symbol: CFAP161
  Gene Name: cilia and flagella associated protein 161
  ENSP ID: ENSP00000454135
MKDFLEKRDKGKLLIQRSRRLKQNLLRPMQLSVTEDGYIHYGDKVMLVNPDDPDTEADVFLRGDLSLCMTPDEIQSHLKDELEVPCGLSAVQAKTPIGRNTFIIL

SEQ ID NO: 17208 - protein, 193 aa, Homo sapiens
  Payload ID: 3467
  Gene Symbol: CFAP20
  Gene Name: cilia and flagella associated protein 20
  Uniprot ID: Q9Y6A4
  ENSP ID: ENSP00000262498
MFKNTFQSGFLSILYSIGSKPLQIWDKKVRNGHIKRITDNDIQSLVLEIEGTNVSTTYITCPADPKKTLGIKLPFLVMIIKNLKKYFTFEVQVLDDKNVRRRFRASNYQSTTRVKPFICTMPMRLDDGWNQIQFNLLDFTRRAYGTNYIETLRVQIHANCRIRRVYFSDRLYSEDELPAEFKLYLPVQNKAKQ

SEQ ID NO: 17209 - protein, 108 aa, Homo sapiens
  Payload ID: 3467
  Gene Symbol: CFAP20
  Gene Name: cilia and flagella associated protein 20
  ENSP ID: ENSP00000455220
MFKNTFQSGFLSILYSIGSKPLQIWDKKVRNGHIKRITDNDIQSLVLEIEGTNVSTTYITCPADPKKTLGIKLPFLVMIIKNLKKYFTFEVQMTRMCVVAFGQVTTRA

SEQ ID NO: 17210 - protein, 622 aa, Homo sapiens
  Payload ID: 3468
  Gene Symbol: CFAP206
  Gene Name: cilia and flagella associated protein 206
  Uniprot ID: Q8IYR0
  ENSP ID: ENSP00000358575
MPPTQAESVIRSIIREIGQECAAHGEIVSETLIAFMVKAVVLDPSNGFNMDRTLMKSDVQNLVKLCMTRLLDTKNPSLDTIKMQVYFDMNYTNRVEFLEEHHRVLESRLGSVTREITDNRACAKEELESLYRKIISYVLLRSGLGSPTDIKTVREVTAALQSVFPQAELGTFLTLSKKDKERQLKELTMIVTGIRLFNRDCGKGGEGIDDLPAVLHVAIPATMQHIDYQLETARSQVYRYTAILEKAANDPLMRAELQPYMLKEALYNIRQYEVFLQIILSDIITGAQEVEMMTKQLGAHLEQLKMTIKSKIAVPTSQVFPIFIALSTLWTSLQDETIVVGVLSNLFTHIQPFLGAHELYFPERVMQCHLNGATVKTDVCRMKEHMEDRVNVADFRKLEWLFPETTANFDKLLIQYRGFCAYTFAATDGLLLPGNPAIGILKYKEKYYTFNSKDAAYSFAENPEHYIDIVREKAKKNTELIQLLELHQQFETFIPYSQMRDADKHYIKPITKCESSTQTNTHILPPTIVRSYEWNEWELRRKAIKLANLRQKVTHSVQTDLSHLRRENCSQVYPPKDTSTQSMREDSTGVPRPQIYLAGLRGGKSEITDEVKVNLTRDVDET

SEQ ID NO: 17211 - protein, 251 aa, Homo sapiens
  Payload ID: 3468
  Gene Symbol: CFAP206
  Gene Name: cilia and flagella associated protein 206
  ENSP ID: ENSP00000422494
MPPTQAESVIRSIIREIGQECAAHGEIVSETLIAFMVKAVVLDPSNGFNMDRTLMKSDVQNLVKLCMTRLLDTKNPSLDTIKMQVYFDMNYTNRVEFLEEHHRVLESRLGSVTREITDNRACAKEELESLYRKIISYVLLRSGLGSPTDIKTVREVTAALQSVFPQAELGTFLTLSKKDKERQLKELTMIVTGIRLFNRDCGKGGEGIDDLPAVLHVAIPATMQHIDYQLETARSQVYRYTAILEKAANDP

SEQ ID NO: 17212 - protein, 95 aa, Homo sapiens
  Payload ID: 3468
  Gene Symbol: CFAP206
  Gene Name: cilia and flagella associated protein 206
  ENSP ID: ENSP00000423543
MPPTQAESVIRSIIREIGQECAAHGEIVSETLIAFMVKAVVLDPSNGFNMDRTLMKSDVQNLVKLCMTRLLDTKNPSLDTIKMQVYFDMNYTNRA

SEQ ID NO: 17213 - protein, 269 aa, Homo sapiens
  Payload ID: 3469
  Gene Symbol: CFAP221
  Gene Name: cilia and flagella associated protein 221
  ENSP ID: ENSP00000295220
MAVVKTPSRGLKNAKEPFNNASPHLLKNLVEEPKKRKEVPNHLLESKVYAKLVNNKVIQARPGIIHFGGYQVEKQHQQILHLVNVSNEDTRVHILPPQTKYFEINYVRKEHHLVPGLSLTVTVTFSPDEWRYYYDCIRVHCKGDDTLLVPIHAYPVMNSLDFPSFINLSNVLLGESKTYVIPLQCSCPVDFEFYITLIQSHQAFAIEPTSGIIPANGKMTVTIKFTPFQYGTAQIKMQLWISQFNSQPYECVFTGTCYPNMALPSLSQL

SEQ ID NO: 17214 - protein, 53 aa, Homo sapiens
  Payload ID: 3469
  Gene Symbol: CFAP221
  Gene Name: cilia and flagella associated protein 221
  ENSP ID: ENSP00000391760
MAVVKTPSRGLKNAKEPFNNASPHLLKNLVEEPKKRKEVPNHLLESTSGQCFQ

SEQ ID NO: 17215 - protein, 840 aa, Homo sapiens
  Payload ID: 3469
  Gene Symbol: CFAP221
  Gene Name: cilia and flagella associated protein 221
  Uniprot ID: Q4G0U5
  ENSP ID: ENSP00000393222
MAVVKTPSRGLKNAKEPFNNASPHLLKNLVEEPKKRKEVPNHLLESKVYAKLVNNKVIQARPGIIHFGGYQVEKQHQQILHLVNVSNEDTRVHILPPQTKYFEINYVRKEHHLVPGLSLTVTVTFSPDEWRYYYDCIRVHCKGDDTLLVPIHAYPVMNSLDFPSFINLSNVLLGESKTYVIPLQCSCPVDFEFYITLIQSHQAFAIEPTSGIIPANGKMTVTIKFTPFQYGTAQIKMQLWISQFNSQPYECVFTGTCYPNMALPLEEFERLNTLSKKVNVPPEKAMMHINFHRPPAKPKPQKVKEIEYQNLRFPVDLSNPFAVATVLNQEPGKLKIKELREVLDQGTEISKTRQMKEALFEQKVRQDIHEEMENHLKWQVHLGKDPMSFKLKKELTEEWQKACAKYKLDRGDPILDEEFQRLKTEVSHKRVVRNQEEKIKEFHPTFDPLINNTWLSRSRAQKRFQQVARKVMIQGRLFNMLSAVREMDKESILRKIGQAKQSIAQEANFFKFFLRRISQDDYTSRFSVSPKEVLPFAFPDCSPPQDSNELAPDGLGLVPIKSSEVQIKQSYSFFNLQVPQLYKIKRYQPFSVHKSSTSYRPQKLARALKQGAEDEVTTITALPKQDSTTQLSGKTSVLSMKPPEALAMSLDYDPLYVFNPNPGLFAVMHPLTYAETLIDYHLCSHPKYKFTKESRHGSSIPVTQKQFLHHTDIIPGIMHWKSFQSLVLSSLPDPSKMETTKSCDSFNSFMLPIDVPAILDALPEEDRLETVERELCEQNVEVMLTPEMIKVEFPMLNYKDIRKEKEVKDQAQPAEKAGEKLLEEMRNLRGKALNTYLILE

SEQ ID NO: 17216 - protein, 96 aa, Homo sapiens
  Payload ID: 3469
  Gene Symbol: CFAP221
  Gene Name: cilia and flagella associated protein 221
  ENSP ID: ENSP00000399793
  MOD_RES (1)..(1): Any amino acid
XSRHGSSIPVTQKQFLHHTDIIPGIMHWKSFQSLVLSSLPDPSKMETTKSCDSFNSFMLPIDVPAILDALPEEDRLETVERSTWICCCICDDRVGV

SEQ ID NO: 17217 - protein, 175 aa, Homo sapiens
  Payload ID: 3469
  Gene Symbol: CFAP221
  Gene Name: cilia and flagella associated protein 221
  ENSP ID: ENSP00000409912
MAVVKTPSRGLKNAKEPFNNASPHLLKNLVEEPKKRKEVPNHLLESKVYAKLVNNKVIQARPGIIHFGGYQVEKQHQQILHLVNVSNEDTRVHILPPQTKYFEINYVRKEHHLVPGLSLTVTVTFSPDEWRYYYDCIRVHCKGDDTLLVPIHAYPVMNSLDFPSFINLSNVLLGE

SEQ ID NO: 17218 - protein, 399 aa, Homo sapiens
  Payload ID: 3469
  Gene Symbol: CFAP221
  Gene Name: cilia and flagella associated protein 221
  ENSP ID: ENSP00000413299
  MOD_RES (1)..(1): Any amino acid
XHPTFDPLINNTWLSRSRAQKRFQQVARKVMIQGRLFNMLSAVREMDKESILRKIGQAKQSIAQEANFFKFFLRRISQDDYTSRFSVSPKEVLPFAFPDCSPPQDSNELAPDGLGLVPIKSSEVQIKQSYSFFNLQVPQLYKIKRYQPFSVHKSSTSYRPQKLARALKQGAEDEVTTITALPKQDSTTQLSGKTSVLSMKPPEALAMSLDYDPLYVFNPNPGLFAVMHPLTYAETLIDYHLCSHPKYKFTKESRHGSSIPVTQKQFLHHTDIIPGIMHWKSFQSLVLSSLPDPSKMETTKSCDSFNSFMLPIDVPAILDALPEEDRLETVERELCEQNVEVMLTPEMIKVEFPMLNYKDIRKEKEVKDQAQPAEKAGEKLLEEMRNLRGKALNTYLILE

SEQ ID NO: 17219 - protein, 173 aa, Homo sapiens
  Payload ID: 3469
  Gene Symbol: CFAP221
  Gene Name: cilia and flagella associated protein 221
  ENSP ID: ENSP00000470283
  MOD_RES (1)..(1): Any amino acid
XKNAKEPFNNASPHLLKNLVEEPKKRKEVPNHLLESKVYAKLVNNKVIQARPGIIHFGGYQVEKQHQQILHLVNVSNEDTRVHILPPQTKYFEINYVRKEHHLVPGLSLTVTVTFSPDEWRYYYDCIRVHCKGDDTLLVPIHAYPVMNSLDFPSFINLSNVLLGERIRKHLTE

SEQ ID NO: 17220 - protein, 134 aa, Homo sapiens
  Payload ID: 3469
  Gene Symbol: CFAP221
  Gene Name: cilia and flagella associated protein 221
  ENSP ID: ENSP00000470662
MAVVKTPSRGLKNAKEPFNNASPHLLKNLVEEPKKRKEVPNHLLESKVYAKLVNNKVIQARPGIIHFGGYQVEKQHQQILFTEKAHWHDVPWNCLRHYLVEISLPAPSLCLLTAFSAIHHVDHSSLLPQTPGLK

SEQ ID NO: 17221 - protein, 90 aa, Homo sapiens
  Payload ID: 3469
  Gene Symbol: CFAP221
  Gene Name: cilia and flagella associated protein 221
  ENSP ID: ENSP00000470784
MAVVKTPSRGLKNAKEPFNNASPHLLKNLVEEPKKRKEVPNHLLESKVYAKLVNNKVIQARPGIIHFGGYQVEKQHQQILVLAGSPVLGV

SEQ ID NO: 17222 - protein, 118 aa, Homo sapiens
  Payload ID: 3469
  Gene Symbol: CFAP221
  Gene Name: cilia and flagella associated protein 221
  ENSP ID: ENSP00000471092
  MOD_RES (1)..(1): Any amino acid
XGDPILDEEFQRLKTEVSHKRVVRNQEEKIKEFHPTFDPLINNTWLSRSRAQKRFQQVARKVMIQGRLFNMLSAVREMDKESILRKIGQAKQSIAQGEVWLQSTEMPRLIMPLSVNFP

SEQ ID NO: 17223 - protein, 88 aa, Homo sapiens
  Payload ID: 3469
  Gene Symbol: CFAP221
  Gene Name: cilia and flagella associated protein 221
  ENSP ID: ENSP00000471998
  MOD_RES (1)..(1): Any amino acid
XFNLQVPQLYKIKRYQPFSVHKSSTSYRPQKLARALKQGAEDEVTTITALPKQDSTTQLSGKTSVLSMKPPEALAMSLDYDPLYVFTS

SEQ ID NO: 17224 - protein, 46 aa, Homo sapiens
  Payload ID: 3469
  Gene Symbol: CFAP221
  Gene Name: cilia and flagella associated protein 221
  ENSP ID: ENSP00000472069
VIPLQCSCPVDFEFYITLIQSHQAFAIEPTSGTRSIIYAHLPGILC

SEQ ID NO: 17225 - protein, 187 aa, Homo sapiens
  Payload ID: 3469
  Gene Symbol: CFAP221
  Gene Name: cilia and flagella associated protein 221
  Uniprot ID: Q4G0U5
  ENSP ID: ENSP00000472563
MAVVKTPSRGLKNAKEPFNNASPHLLKNLVEEPKKRKEVPNHLLESKVYAKLVNNKVIQARPGIIHFGGYQVEKQHQQILHLVNVSNEDTRVHILPPQTKYFEINYVRKEHHLVPGLSLTVTVTFSPDEWRYYYDCIRVHCKGDDTLLVPIHAYPVMNSLDFPSFINLSNVLLGESLPNSVFLVPDN

SEQ ID NO: 17226 - protein, 342 aa, Homo sapiens
  Payload ID: 3470
  Gene Symbol: CFAP36
  Gene Name: cilia and flagella associated protein 36
  Uniprot ID: Q96G28
  ENSP ID: ENSP00000295117
MAAEEEDEVEWVVESIAGFLRGPDWSIPILDFVEQKCEVFDDEEESKLTYTEIHQEYKELVEKLLEGYLKEIGINEDQFQEACTSPLAKTHTSQAILQPVLAAEDFTIFKAMMVQKNIEMQLQAIRIIQERNGVLPDCLTDGSDVVSDLEHEEMKILREVLRKSKEEYDQEEERKRKKQLSEAKTEEPTVHSSEAAIMNNSQGDGEHFAHPPSEVKMHFANQSIEPLGRKVERSETSSLPQKDLKIPGLEHASIEGPIANLSVLGTEELRQREHYLKQKRDKLMSMRKDMRTKQIQNMEQKGKPTGEVEEMTEKPEMTAEEKQTLLKRRLLAEKLKEEVINK

SEQ ID NO: 17227 - protein, 367 aa, Homo sapiens
  Payload ID: 3470
  Gene Symbol: CFAP36
  Gene Name: cilia and flagella associated protein 36
  Uniprot ID: Q96G28
  ENSP ID: ENSP00000342699
MAAEEEDEVEWVVESIAGFLRGPDWSIPILDFVEQKCEVNCKGGHVITPGSPEPVILVACVPLVFDDEEESKLTYTEIHQEYKELVEKLLEGYLKEIGINEDQFQEACTSPLAKTHTSQAILQPVLAAEDFTIFKAMMVQKNIEMQLQAIRIIQERNGVLPDCLTDGSDVVSDLEHEEMKILREVLRKSKEEYDQEEERKRKKQLSEAKTEEPTVHSSEAAIMNNSQGDGEHFAHPPSEVKMHFANQSIEPLGRKVERSETSSLPQKDLKIPGLEHASIEGPIANLSVLGTEELRQREHYLKQKRDKLMSMRKDMRTKQIQNMEQKGKPTGEVEEMTEKPEMTAEEKQTLLKRRLLAEKLKEEVINK

SEQ ID NO: 17228 - protein, 313 aa, Homo sapiens
  Payload ID: 3470
  Gene Symbol: CFAP36
  Gene Name: cilia and flagella associated protein 36
  ENSP ID: ENSP00000385376
MAAEEEDEVEWVVESIAGFLRGPDWSIPILDFVEQKCEVFDDEEESKLTYTEIHQEYKELVEKLLEGYLKEIGINEDQFQEACTSPLAKTHTSQAILQPVLAAEDFTIFKAMMVQKNIEMQLQAIRIIQERNGVLPDCLTDGSDVVSDLEHEEMKILREVLRKSKEEYDQEEERKRKKQLSEAKTEEPTVHSSEAAIMNNSQGDGEHFAHPPSDLKIPGLEHASIEGPIANLSVLGTEELRQREHYLKQKRDKLMSMRKDMRTKQIQNMEQKGKPTGEVEEMTEKPEMTAEEKQTLLKRRLLAEKLKEEVINK

SEQ ID NO: 17229 - protein, 218 aa, Homo sapiens
  Payload ID: 3470
  Gene Symbol: CFAP36
  Gene Name: cilia and flagella associated protein 36
  ENSP ID: ENSP00000385400
MAAEEEDEVEWVVESIAGFLRGPDWSIPILDFVEQKCEVFDDEEESKLTYTEIHQEYKELVEKLLEGYLKEIGINEDQFQEACTSPLAKTHTSQAILQPVLAAEDFTIFKAMMVQKNIEMQLQAIRIIQERNGVLPDCLTDGSDVVSDLEHEEMKILREVLRKSKEEYDQEEERKRKKQLSEAKTEEPTVHSSEAAIMNNSQGDGEHFAHPPSEIQGS

SEQ ID NO: 17230 - protein, 223 aa, Homo sapiens
  Payload ID: 3470
  Gene Symbol: CFAP36
  Gene Name: cilia and flagella associated protein 36
  ENSP ID: ENSP00000385972
MAAEEEDEVEWVVESIAGFLRGPDWSIPILDFVEQKCEVFDDEEESKLTYTEIHQEYKELVEKLLEGYLKEIGINEDQFQEACTSPLAKTHTSQAILQPVLAAEDFTIFKAMMVQKNIEMQLQAIRIIQERNGVLPDCLTDGSDVVSDLEHEEMKILREVLRKSKEEYDQEEERKRKKQVPTEHITEVFYCCYLLLSLHLDLTIKIYTYVELHNFKYNVNIDQ

SEQ ID NO: 17231 - protein, 870 aa, Homo sapiens
  Payload ID: 3471
  Gene Symbol: CFAP43
  Gene Name: cilia and flagella associated protein 43
  ENSP ID: ENSP00000278064
MATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVVYDQQGIFLLVGTAEGKVFIINANSSSSFQIIGFTEVAKDILQISTVSLLETDIVEVMVLSSLPEAGRSRLEMFTLPTLLPQVSTTFADERGRLKDEIIHKYLYELEHALSSAVLGFQSNQIYGFCSQVPYICSYLLPEEEHTGIYILKPYKKVQSRQYGPGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKVLF

SEQ ID NO: 17232 - protein, 1665 aa, Homo sapiens
  Payload ID: 3471
  Gene Symbol: CFAP43
  Gene Name: cilia and flagella associated protein 43
  Uniprot ID: Q8NDM7
  ENSP ID: ENSP00000349568
MAQGRERDEGPHSAGGASLSVRWVQGFPKQNVHFVNDNTICYPCGNYVIFINIETKKKTVLQCSNGIVGVMATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVVYDQQGIFLLVGTAEGKVFIINANSSSSFQIIGFTEVAKDILQISTVSLLETDIVEVMVLSSLPEAGRSRLEMFTLPTLLPQVSTTFADERGRLKDEIIHKYLYELEHALSSAVLGFQSNQIYGFCSQVPYICSYLLPEEEHTGIYILKPYKKVQSRQYGPGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKLRKEIVEAQSGVKLIKQRHEEDDEEEEEEDKTVKYSNLPNYLLGSLSTDFGVDTSLLSSQLELHSREEKINQIILLKDIIYKVKTVFNNEFDAAYKQKEFEIARVKERNVRIREIILDLELEEAVWQPEFEDCEKPERTLVVQDEEITAHKHIKPWHKAKELIVNHEKEHWLLIQDASTRLRALMDMMGGVLEVKKEDILRMVIPQPAFMAKPDAVWTEEERKQFKDYEKKVKELNEERDKYRKSLEAELKKLQNSIQESTQAFDEHLKRLFERRVKAEMVTNQEELKISNLAFSLLLDEELSSREKFLNNYLTRKQHEKSQTSEAVRKSREDLDVCKEHYDNLLAEDKVMDRSFKKEFSEIPGHQVDILYKLFKRRPRISKQKTHSETTSVVPFGELPGSGKLNKDAFAQLMKAMDELDNISNMPEGLDPLVWNHFCMTRRAKVENEQKVKQKAADLLEMATFLQKRVEEEEKVQQEIERVFHELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKYLNEPNYEALISIQIGIMEQTIAVLDKMHKKNVENCKKLLKKLGKFSNQKDIANYALSCNLREELVAVSERKDICNAMGSKLTCEKIVKERYENMMQQQKLTNISKQQAEQISILQTEVERLRMKTFPALVQM

SEQ ID NO: 17233 - protein, 303 aa, Homo sapiens
  Payload ID: 3471
  Gene Symbol: CFAP43
  Gene Name: cilia and flagella associated protein 43
  ENSP ID: ENSP00000358733
MATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKVCWMVIS

SEQ ID NO: 17234 - protein, 412 aa, Homo sapiens
  Payload ID: 3471
  Gene Symbol: CFAP43
  Gene Name: cilia and flagella associated protein 43
  ENSP ID: ENSP00000358734
MATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVV

SEQ ID NO: 17235 - protein, 997 aa, Homo sapiens
  Payload ID: 3471
  Gene Symbol: CFAP43
  Gene Name: cilia and flagella associated protein 43
  ENSP ID: ENSP00000391364
  MOD_RES (1)..(1): Any amino acid
XPGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKLRKEIVEAQSGVKLIKQRHEEDDEEEEEEDKTVKYSNLPNYLLGSLSTDFGVDTSLLSSQLELHSREEKINQIILLKDIIYKVKTVFNNEFDAAYKQKEFEIARVKERNVRIREIILDLELEEAVWQPEFEDCEKPERTLVVQDEEITAHKHIKPWHKAKELIVNHEKEHWLLIQDASTRLRALMDMMGGVLEVKKEDILRMVIPQPAFMAKPDAVWTEEERKQFKDYEKKVKELNEERDKYRKSLEAELKKLQNSIQESTQAFDEHLKRLFERRVKAEMVTNQEELKISNLAFSLLLDEELSSREKFLNNYLTRKQHEKVMDRSFKKEFSEIPGHQVDILYKLFKRRPRISKQKTHSETTSVVPFGELPGSGKLNKDAFAQLMKAMDELDNISNMPEGLDPLVWNHFCMTRRAKVENEQKVKQKAADLLEMATFLQKRVEEEEKVQQEIERVFHELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKYLNEPNYEALISIQIGIMEQTIAVLDKMHKKNVENCKKLLKKLGKFSNQKDIANYALSCNLREELVAVSERKDICNAMGSKLTCEKIVKERYENMMQQQKLTNISKQQAEQISILQTEVERLRMKTFPALVQM

SEQ ID NO: 17236 - protein, 514 aa, Homo sapiens
  Payload ID: 3471
  Gene Symbol: CFAP43
  Gene Name: cilia and flagella associated protein 43
  ENSP ID: ENSP00000394274
  MOD_RES (1)..(1): Any amino acid
XWTEEERKQFKDYEKKVKELNEERDKYRKSLEAELKKLQNSIQESTQAFDEHLKRLFERRVKAEMVTNQEELKISNLAFSLLLDEELSSREKFLNNYLTRKQHEKSQTSEAVRKSREDLDVCKEHYDNLLAEDKVMDRSFKKEFSEIPGHQVDILYKLFKRRPRISKQKTHSETTSVVPFGELPGSGKLNKDAFAQLMKAMDELDNISNMPEGLDPLVWNHFCMTRRAKVENEQKVKQKAADLLEMATFLQKRVEEEEKVQQEIERVFHELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKYLNEPNYEALISIQIGIMEQTIAVLDKMHKKNVENCKKLLKKLGKFSNQKDIANYALSCNLREELVAVSERKDICNAMGSKLTCEKIVKERYENMMQQQKLTNISKQQAEQISILQTEVERLRMKTFPALVQM

SEQ ID NO: 17237 - protein, 982 aa, Homo sapiens
  Payload ID: 3472
  Gene Symbol: CFAP44
  Gene Name: cilia and flagella associated protein 44
  Uniprot ID: Q96MT7
  ENSP ID: ENSP00000295868
MKEPDDQDTDGEKSVTSKSDGKKSLRSSKSESRSPVQEDNTFLEDDTDETFTKGEGSYLEEDSDEERLEGSLSSFQYGDLQSTTVPQQTPAPAVEEAEEEVKKKISESFFYDYMELASMPFVTLDSNIPLDLLTLVHSFGYDCRKRANLQLLDDSIAIYIAGNQLIFLNLKTKEQIYLRSSSGEGIGVIGVHPHKTYFTVAEKGSFPDIIIYEYPSLRPYRVLRDGTEKGYAYVDFNYSGNLLASVGSNPDYTLTIWNWKEEQPILRTKAFSQEVFKVTFNPDKEEQLTTSGSGHIKFWEMAFTFTGLKLQGSLGRFGKTITTDIEGYMELPDGKVLSGSEWGNMLLWEGGLIKVELCRGTSKSCHNGPINQIMLYEGEVITVGSDGYVRIWDFETIDTADVIDETGLLEIEPINELQVDKNVNLFSMIKMNETGNNFWLAQDANGAIWKLDLSFSNITQDPECLFSFHSGAIEAVAVSPLTYLMATTALDCSVRIYDFASKTPLAQMKFKQGGTALVWVPRMVNFTGAQIIVGFEDGVVRILELYDPKGLTIFAGRKKILDADIQLKQVFKPHTACVTALAYERDGEILATGSKDQTVFFFEVERDYKPIGYINTPGPVCQLMWSPMSHPESTLLIICENGYILEAPLPTIKQEEDDHDVVSYEIKDMCIKCFHFSSVKSKILRLIEIEKRERQRELKEKIREERRNKLAAEMGEDGEKEFQEEEEEKEEEEEEEEPLPEIFIPSTPSPILCGFYSEPGKFWVSLGGYDSGFLYHCEFPPCDESSDFKEQKDEPIDVRYLADTEDNPIQTITFNINKVMMFCGMKNGAIRVYVLNQNDPSLTSLVDYWHFNMHDNNYGCIKSIANSFDDRFLVTAGADGNIFVFNIFSEFMLRKDMKAKVPSPRFGIETEPIPEDIEDPKAYSIENARRKREHDKLMKEVGEIKARKREQIKALRSEFCNLLEMNEKLPKHMQFKRTVSLI

SEQ ID NO: 17238 - protein, 1854 aa, Homo sapiens
  Payload ID: 3472
  Gene Symbol: CFAP44
  Gene Name: cilia and flagella associated protein 44
  Uniprot ID: Q96MT7
  ENSP ID: ENSP00000377428
MKEPDDQDTDGEKSVTSKSDGKKSLRSSKSESRSPVQEDNTFLEDDTDETFTKGEGSYLEEDSDEERLEGSLSSFQYGDLQSTTVPQQTPAPAVEEAEEEVKKKISESFFYDYMELASMPFVTLDSNIPLDLLTLVHSFGYDCRKRANLQLLDDSIAIYIAGNQLIFLNLKTKEQIYLRSSSGEGIGVIGVHPHKTYFTVAEKGSFPDIIIYEYPSLRPYRVLRDGTEKGYAYVDFNYSGNLLASVGSNPDYTLTIWNWKEEQPILRTKAFSQEVFKVTFNPDKEEQLTTSGSGHIKFWEMAFTFTGLKLQGSLGRFGKTITTDIEGYMELPDGKVLSGSEWGNMLLWEGGLIKVELCRGTSKSCHNGPINQIMLYEGEVITVGSDGYVRIWDFETIDTADVIDETGLLEIEPINELQVDKNVNLFSMIKMNETGNNFWLAQDANGAIWKLDLSFSNITQDPECLFSFHSGAIEAVAVSPLTYLMATTALDCSVRIYDFASKTPLAQMKFKQGGTALVWVPRMVNFTGAQIIVGFEDGVVRILELYDPKGLTIFAGRKKILDADIQLKQVFKPHTACVTALAYERDGEILATGSKDQTVFFFEVERDYKPIGYINTPGPVCQLMWSPMSHPESTLLIICENGYILEAPLPTIKQEEDDHDVVSYEIKDMCIKCFHFSSVKSKILRLIEIEKRERQRELKEKIREERRNKLAAEMGEDGEKEFQEEEEEKEEEEEEEEPLPEIFIPSTPSPILCGFYSEPGKFWVSLGGYDSGFLYHCEFPPCDESSDFKEQKDEPIDVRYLADTEDNPIQTITFNINKVMMFCGMKNGAIRVYVLNQNDPSLTSLVDYWHFNMHDNNYGCIKSIANSFDDRFLVTAGADGNIFVFNIFSEFMLRKDMKAKVPSPRFGIETEPIPEDIEDPKAYSIENARRKREHDKLMKEVGEIKARKREQIKALRSEFCNLLEMNEKLPKHMQFKRTDFDVDSQIRAEMHRKTAFKIQQVEKELAWEKEKHELGLMKLKNRFRDPLESDTIVVHAILSDHKISSYRLVQPSKYSKFKRASQSERKPSKLDRFEKEGPGRKDSQRDAGGSVTIQEESIIEKGKKFRPKTLSEIIVENQIEKTRKLILKAERAQLKIQQRKKEWEELYKSKPGDDYEDPKDLQAIKEAQVYMGDFNLKTAPDYKIPEHMRINAAKKEEELGHLDSLVHGNKRHMNKCILSLRDLKVAVVEEIQCLVQELKNIQSTLHISKHIPIPKIPQIHPEEVPEKRFQYDEETLLNFKQQQMKSKDEKSPGVEQTGSGGPVGGFLKLSSRKDGDLTTRDSISRSSKASTFSLDIPKCLEFEKAEPTDVELEIMKRDEIKHVYMQQYLVNRIKELVVTFDAELRLLRHQKLKLDTQMKLSDLHHVTLFQEILLLKNFEKQENILQERVNSLDKEEQYMQWKINETLKEMEEKKNEITKLQEQEKALYAGFQAAIGENNKFANFLMKVLKKKIKRVKKKEVEGDADEDEESEESSEEESSLESDEDESESEDEVFDDSICPTNCDVALFELALHLREKRLDIEEALVEEKKIVDNLKKEYDTLSKKVKIVATNLNAAEEALEAYQREKQQRLNELLVVIPLKLHQIEYVVFGEIPSDLSGTLVFSNHALRRLQERIHELQEENSKQQKLNKEWRERRKQLIREKREMTKTIHKMEETVRQLMISKFGRVVNLEALQTLSVNTTLEELKIRKLRKELANAKEMKMWEEKIAQMRWELMMKTKEHTRKLYQMNDLCIEKKKLDSRLNTLQNQQGNAFQGPREADVVAREEVTELIQLQAERISALKEEIALLRRKGSLILPPIQSPREKEIQPADL

SEQ ID NO: 17239 - protein, 991 aa, Homo sapiens
  Payload ID: 3472
  Gene Symbol: CFAP44
  Gene Name: cilia and flagella associated protein 44
  ENSP ID: ENSP00000417371
  MOD_RES (1)..(1): Any amino acid
XANSFDDRFLVTAGADGNIFVFNIFSEFMLRKDMKAKVPSPRFGIETEPIPEDIEDPKAYSIENARRKREHDKLMKEVGEIKARKREQIKALRSEFCNLLEMNEKLPKHMQFKRTDFDVDSQIRAEMHRKTAFKIQQVEKELAWEKEKHELGLMKLKNRFRDPLESDTIVVHAILSDHKISSYRLVQPSKYSKFKRASQSERKPSKLDRFEKEGPGRKDSQRDAGGSVTIQEESIIEKGKKFRPKTLSEIIVENQIEKTRKLILKAERAQLKIQQRKKEWEELYKSKPGDDYEDPKDLQAIKEAQVYMGDFNLKTAPDYKIPEHMRINAAKKEEELGHLDSLVHGNKRHMNKCILSLRDLKVAVVEEIQCLVQELKNIQSTLHISKHIPIPKIPQIHPEEVPEKRFQYDEETLLNFKQQQMKSKDEKSPGVEQTGSGGPVGGFLKLSSRKDGDLTTRDSISRSSKASTFSLDIPKCLEFEKAEPTDVELEIMKRDEIKHVYMQQYLVNRIKELVVTFDAELRLLRHQKLKLDTQMKLSDLHHVTLFQEILLLKNFEKQENILQERVNSLDKEEQYMQWKINETLKEMEEKKNEITKLQEQEKALYAGFQAAIGENNKFANFLMKVLKKKIKRVKKKEVEGDADEDEESEESSEEESSLESDEDESESEDEVFDDSICPTNCDVALFELALHLREKRLDIEEALVEEKKIVDNLKKEYDTLSKKVKIVATNLNAAEEALEAYQREKQQRLNELLVVIPLKLHQIEYVVFGEIPSDLSGTLVFSNHALRRLQERIHELQEENSKQQKLNKEWRERRKQLIREKREMTKTIHKMEETVRQLMISKFGRVVNLEALQTLSVNTTLEELKIRKLRKELANAKEMKMWEEKIAQMRWELMMKTKEHTRKLYQMNDLCIEKKKLDSRLNTLQNQQGNAFQGPREADVVAREEVTELIQLQAERISALKEEIALLRRKGSLILPPIQSPREKEIQPADL

SEQ ID NO: 17240 - protein, 56 aa, Homo sapiens
  Payload ID: 3472
  Gene Symbol: CFAP44
  Gene Name: cilia and flagella associated protein 44
  ENSP ID: ENSP00000418257
  MOD_RES (1)..(1): Any amino acid
XVFSNHALRRLQERIHELQEENSKQQKLNKEWRERRKQLIREKREMTKTIHMTVFF

SEQ ID NO: 17241 - protein, 26 aa, Homo sapiens
  Payload ID: 3472
  Gene Symbol: CFAP44
  Gene Name: cilia and flagella associated protein 44
  ENSP ID: ENSP00000418743
TVGSDGYVRDANGAIWKLDLSFSNII

SEQ ID NO: 17242 - protein, 419 aa, Homo sapiens
  Payload ID: 3472
  Gene Symbol: CFAP44
  Gene Name: cilia and flagella associated protein 44
  ENSP ID: ENSP00000418795
  MOD_RES (1)..(1): Any amino acid
XDAELRLLRHQKLKLDTQMKLSDLHHVTLFQEILLLKNFEKQENILQERVNSLDKEEQYMQWKINETLKEMEEKKNEITKLQEQEKALYAGFQAAIGENNKFANFLMKVLKKKIKRVKKKEVEGDADEDEESEESSEEESSLESDEDESESEDEVFDDSICPTNCDVALFELALHLREKRLDIEEALVEEKKIVDNLKKEYDTLSKKVKIVATNLNAAEEALEAYQREKQQRLNELLVVIPLKLHQIEYVVFGEIPSDLSGTLVFSNHALRRLQERIHELQEENSKQQKLNKEWRERRKQLIREKREMTKTIHKMEETVRQLMISKFGRVVNLEALQTLSVNTTLEELKIRKLRKELANAKEMKMWEEKIAQMRWELMMKTKEHTRKLYQMNDLCIEKKKLDSRLNTLQNQQNPGNGLS

SEQ ID NO: 17243 - protein, 119 aa, Homo sapiens
  Payload ID: 3472
  Gene Symbol: CFAP44
  Gene Name: cilia and flagella associated protein 44
  ENSP ID: ENSP00000419269
  MOD_RES (1)..(1): Any amino acid
XSIENARRKREHDKLMKEVGEIKARKREQIKALRSEFCNLLEMNEKLPKHMQFKRTDFDVDSQIRAEMHRKTAFKIQQVEKELAWEKEKHELGLMKLKNRWECYHTRRINNRKREEISA

SEQ ID NO: 17244 - protein, 84 aa, Homo sapiens
  Payload ID: 3472
  Gene Symbol: CFAP44
  Gene Name: cilia and flagella associated protein 44
  ENSP ID: ENSP00000419671
MKEPDDQDTDGEKSVTSKSDGKKSLRSSKSESRSPVQEDNTFLEDDTDETFTKGEGSYLEEDSDEERLEGSLSSFQYGDLQSTT

SEQ ID NO: 17245 - protein, 37 aa, Homo sapiens
  Payload ID: 3472
  Gene Symbol: CFAP44
  Gene Name: cilia and flagella associated protein 44
  ENSP ID: ENSP00000419844
MKEPDDQDTDGEKSVTSKSDGKKSLRSSKSESRCSST

SEQ ID NO: 17246 - protein, 10 aa, Homo sapiens
  Payload ID: 3472
  Gene Symbol: CFAP44
  Gene Name: cilia and flagella associated protein 44
  ENSP ID: ENSP00000420375
  MOD_RES (1)..(1): Any amino acid
XKSESRCSST

SEQ ID NO: 17247 - protein, 551 aa, Homo sapiens
  Payload ID: 3473
  Gene Symbol: CFAP45
  Gene Name: cilia and flagella associated protein 45
  Uniprot ID: Q9UL16
  ENSP ID: ENSP00000357079
MPLSTAGILSSSSAASNRSRNKARYRTKAVSSEVDESLFGDIKSPAQGQSDSPIVLLRDKHTLQKTLTALGLDRKPETIQLITRDMVRELIVPTEDPSGESLIISPEEFERIKWASHVLTREELEARDQAFKKEKEATMDAVMTRKKIMKQKEMVWNNNKKLSDLEEVAKERAQNLLQRANKLRMEQEEELKDMSKIILNAKCHAIRDAQILEKQQIQKELDTEEKRLDQMMEVERQKSIQRQEELERKRREERIRGRRQIVEQMEKNQEERSLLAEQREQEKEQMLEYMEQLQEEDLKDMERRQQQKLKMQAEIKRINDENQKQKAELLAQEKLADQMVMEFTKKKMAREAEFEAEQERIRREKEKEIARLRAMQEKAQDYQAEQDALRAKRNQEVADREWRRKEKENARKKMETEAELRKSRLEQVAFKEHALAVQVQRDRDEFERILRAQREQIEKERLEEEKKATGRLQHANELRRQVRENQQKEVQNRIATFEEGRRLKEEAQKRRERIDEIKRKKLEELRATGLPEKYCIEAERKANILPATSVN

SEQ ID NO: 17248 - protein, 466 aa, Homo sapiens
  Payload ID: 3473
  Gene Symbol: CFAP45
  Gene Name: cilia and flagella associated protein 45
  Uniprot ID: Q9UL16
  ENSP ID: ENSP00000403044
MVRELIVPTEDPSGESLIISPEEFERIKWASHVLTREELEARDQAFKKEKEATMDAVMTRKKIMKQKEMVWNNNKKLSDLEEVAKERAQNLLQRANKLRMEQEEELKDMSKIILNAKCHAIRDAQILEKQQIQKELDTEEKRLDQMMEVERQKSIQRQEELERKRREERIRGRRQIVEQMEKNQEERSLLAEQREQEKEQMLEYMEQLQEEDLKDMERRQQQKLKMQAEIKRINDENQKQKAELLAQEKLADQMVMEFTKKKMAREAEFEAEQERIRREKEKEIARLRAMQEKAQDYQAEQDALRAKRNQEVADREWRRKEKENARKKMETEAELRKSRLEQVAFKEHALAVQVQRDRDEFERILRAQREQIEKERLEEEKKATGRLQHANELRRQVRENQQKEVQNRIATFEEGRRLKEEAQKRRERIDEIKRKKLEELRATGLPEKYCIEAERKANILPATSVN

SEQ ID NO: 17249 - protein, 141 aa, Homo sapiens
  Payload ID: 3473
  Gene Symbol: CFAP45
  Gene Name: cilia and flagella associated protein 45
  ENSP ID: ENSP00000478944
MVRELIVPTEDPSGESLIISPEEFERIKWASHVLTREELEARDQAFKKEKEATMDAVMTRKKIMKQKEMVWNNNKKLSDLEEVAKERAQNLLQRANKLRMEQEEELKDMSKIILNAKCHAIRDAQILEKQQIQKELDTEEK

SEQ ID NO: 17250 - protein, 431 aa, Homo sapiens
  Payload ID: 3473
  Gene Symbol: CFAP45
  Gene Name: cilia and flagella associated protein 45
  ENSP ID: ENSP00000483972
MPLSTAGILSSSSAASNRSRNKARYRTKAVSSEVDESLFGDIKSPAQGQSDSPIVLLRDKHTLQKTLTALGLDRKPETIQLITRDMVRELIVPTEDPSGESLIISPEEFERIKWASHVLTREELEARDQAFKKEKEATMDAVMTRKKIMKQKEMVWNNNKKLSDLEEVAKERAQNLLQRANKLRMEQEEELKDMSKIILNAKCHAIRDAQILEKQQIQKELDTEEKRLDQMMEVERQKSIQRQEELERKRREERIRGRRQIVEQMEKNQEERSLLAEQREQEKEQMLEYMEQLQEEDLKDMERRQQQKLKMQAEIKRINDENQKQKAELLAQEKLADQMVMEFTKKKMAREAEFEAEQERIRREKEKEIARLRAMQEKAQDYQAEQLFCALTGPLPTFPGCLAGQAQPGGCRQRVAQKGKGKCAEEDGNRG

SEQ ID NO: 17251 - protein, 405 aa, Homo sapiens
  Payload ID: 3474
  Gene Symbol: CFAP46
  Gene Name: cilia and flagella associated protein 46
  Uniprot ID: Q8IYW2
  ENSP ID: ENSP00000357574
MDLVITQELARAESQQDAASLKKAYELIKSANLGKSEFDPSESFSPDLFVLCAEQALKMRQPEVSEDCIQMYFKVKAPITQFLGRAHLCRAQMCAPKSAENLEEFENCVTEYMKAINFAKGEPRYYFLVYNASVLYWQMVRPFLKPGYRHHLIPSLSQIINVLSQTEEEDKEWRAELMLELLECYLQAGRKEEAARFCSTAAPFIKSHVPQKYRQIFSVMVRHELMDELQLKEEKKNSISLSVTFYINMLKAKAEQNDLPGDISVILRKAYRHLGHYNHQRFPSISEEKMLLLFELARFSLTLKCMEISSACLSDLKKMESKVSGFMTLLPGDEALLTVQLDKRQRKEEQFTRPRPPGLRSVVGTLPSFLPVFCTVAVRWCLQFYTCPFLFTFLVATGPQHHSCF

SEQ ID NO: 17252 - protein, 2715 aa, Homo sapiens
  Payload ID: 3474
  Gene Symbol: CFAP46
  Gene Name: cilia and flagella associated protein 46
  Uniprot ID: Q8IYW2
  ENSP ID: ENSP00000357575
MDLVITQELARAESQQDAASLKKAYELIKSANLGKSEFDPSESFSPDLFVLCAEQALKMRQPEVSEDCIQMYFKVKAPITQFLGRAHLCRAQMCAPKSAENLEEFENCVTEYMKAINFAKGEPRYYFLVYNASVLYWQMVRPFLKPGYRHHLIPSLSQIINVLSQTEEEDKEWRAELMLELLECYLQAGRKEEAARFCSTAAPFIKSHVPQKYRQIFSVMVRHELMDELQLKEEKKNSISLSVTFYINMLKAKAEQNDLPGDISVILRKAYRHLGHYNHQRFPSISEEKMLLLFELARFSLTLKCMEISSACLSDLKKMESKDPGKLIEMECLECESEALRLESKMKVYNRAAVEAQLDIIQRLDVALQRAVRLGDPRVIHVVCATQWNTCLPLLQHNLRHHLRKPLAGVADVLEKLDSLMTLLRCQVHMEMAQIEEDEDRLEPATEHLRKAARLDSLGLYRDRIQMASTRLRLCTTLYQAPERAEDKAIMAVEQAKKATPKDSVRKKRALLVNAGLALAPDAFQIVLDSENEAKVSTGKNRGRFTYLCAKAWHHTVSVDKAAGHLRRLGNENDKERIQIWAELAKVARKQGVWDVCRTASRFCLLYDNVKVKKLRLRRGKKKRGRDGSVQDTWSQPEVVLQRQVCPDLLRKFAEVGFIHAEATVHLLRSEGVELNDRAIPPEDLSQHPAGYVPEPPEVNAEWITYRTWIESLSRCAMNNWLRSAEIGQEIQEAWIVQNAVVYVLNHNHHLILAGRQKELVDALYHLLSIVKATGHSGDPVMLVTLCNTLARGLIISWIPVQAAEKSRKFMRPNAFHSPLDAGATSEIKTAVEVCEFALNLTNGSAPEETVPTGTRQQLIATWVKAKQLLQQQIGPRLGTEEQGTNEDVSSVTRVLVALEMYSCNGLGLMDFTVPSLAQLVKMASECNWSDPLVELQTLTRLTHFAHAARDHETTMACAHRALEMGIKYLKKFGPEESRLVAEMLCTATAIQGRSIMENLKGRKQLRLVAAKAFTESARFGGIAGSSALVMLAARHYWNAWLPLLSSAVYRKKAKGALKRLIGIINKTEARKQEKGKTLLLHQWPTADFQGGGTTEGYFLPGAEDDLALRAALYGLLFHSHADQDDWEGGLKVLDEAVQVLPRTAHRLLIFKHMVIVKAKLGQNFSMEIQKFKAESEDYLARMWHRLALNSPSVSGELACYNNAIQALQKPEMEWQKVEYLMEFGQWLHHRHFPLEDVVFHLRWAVEILLAMKPPGDVPEPQPTPDGEYVAVEMPPRSPVSEAEEAVSLEQLRSVRQLEALARVHILLALVLSPGAEGYEDCCLAAYAFFRHIWQVSLMTAGKSVLENRPLAATSSHLLLPKKEKENERSKEKEKERSKEKENERSKEKDKEKGKEEKVKEPKQSQSPAPIKQLEDLPMSIEEWASYSCPEEVLSVLKQDRSDSTVNPSSIQKPTYSLYFLDHLVKALQKMCLHELTVPVLQLGVLISDSVVGSKGLSDLYHLRLAHACSELKLREAAARHEEAVGQVCVSELEQASCRKEIALKKEKNKEPLLEESLPALNEQTLPVQPGEIKPLDAKDKILKMNGETGRDLDGTSFPHLWMLKAEVLLEMNLYQPARLLLSEAYLAFQELDEPCAEAQCLLLLAQLANKEKNYGQAKKMIAQAQHLGGSEEFWYNSTLTLAEALLSMEHSGREATVCHIFQKLINAFKILKKERPNRLPLLEFMITDLEARCLSLRVRVAQHSAVTEPTECSLLLKEMDDGLLEIERKFIDCGCKENCVDVKLERAKIKRLRAQNEKDEEQKTAYYLEAYGLAQGAVAEEEGRLHSIQGLYGLAQGAMAEEEGRLHSVQGLLSLQDLQNVNTPLMRKLARLKLGLVEMALDMLQFIWEEAHGQQSEQGSLEKLLADYLQNTSDYTSVGLQWFTLKRTLAHGALAQLGSLQPLSVGCVEIRARLLGLAGRALHLLAMQADPVHPTCYWEAGPSVGAKLSGLKSLELEVEEEGATKSSRDPPASRAAPEEHCRRGEDLKRRMVLAQQYLAQASEVLLQCLQVALGSGLLDVAAAASLEMVECVGTLDPATTCQFLALSQSCSASETMRDVLLAATANTSSSQLAALLQLQHQLRCQDRTTTSLGARVEQRLAAVSKAWQNLCVTEQHFNLLNEMPPTFWILFLHLSGDRSRLYGAAYEKPKFITAAKGKVQAVGGSCKVMRLAISPTAFSHLLACAQQFRKQTQAQVYSEDMALNIGSEPEGLQVEEKERPVQRLSSVLGPLEELLQPLFPLLSLSKARVQTPAVVADSGKSKGKDKERKTSTGQHSTVQPEVADKIVLVADRHLLELPLEGLSVFDEGTISSVSREFSLQMLWNRLHKEETEGGVKKEGRSRDPKKRSLAKKGRKGSIPRTIPPDCIIVDSDNFKFVVDPYEEAQGPEMLTPVSITQDILERFQDTFTSRWAGHLGSKHFPSQAQWEQALGSCSGFFFYGMESFLSHILVERLVAMNLQECQVAVLLDLARSYQSLKRHMESVEHRRSVGRWEANWRNSASPSEDEWRRGGEPRRGFSDLEGQAAAAPKLRAPSHHAQLGPVWAAAPSHRVVQAWTCLPSAAGAPALASALGSAPLPTHPHLPAPIPSSQLALPFLGLSPALGAASARDPPPATSRKAAAWTSSSACLCAPWGLRRGWSCVSSRGQDKGGLPLAALVLSCLDQKTIQTVSLFLI

SEQ ID NO: 17253 - protein, 153 aa, Homo sapiens
  Payload ID: 3474
  Gene Symbol: CFAP46
  Gene Name: cilia and flagella associated protein 46
  ENSP ID: ENSP00000417039
  MOD_RES (1)..(1): Any amino acid
XTQAQVYSEDMALNIGSEPEGLQVEEKERPVQRLSSVLGPLEELLQPLFPLLSLSKARVQTPAVVADSGKSKGKDKERKTSTGQHSTVQPEVADKIVLVADRHLLELPLEGLSVFDEGTISSVSREFSLQMLWNRLHKEETDSEKHEGARGRP

SEQ ID NO: 17254 - protein, 976 aa, Homo sapiens
  Payload ID: 3475
  Gene Symbol: CFAP47
  Gene Name: cilia and flagella associated protein 47
  ENSP ID: ENSP00000297866
MNTQKGSLTINVHRGSLAMSIQRGSLVPRDMDSSGRDMQLRVIPAEVKFLDTMAGRVYRLPITVHNICRWNQKIRFKEPVKPQFKLMLTSLDKELASGLQMTAMVEYHPDKDEDTFDRLLISIENKTTEIPLIGLIPSCQLEIESVVNFGTLVANSKVYSKEITITNHGKAPGIFKAEYHGQLPILIFPTSGIVDAKSSMVIKVDFCADQPRIVDEEAIVILQGQPEMLLSIKAHVVEQIIELLSMSSDRRLECIHFGPVFFGSSKIKHARVYNNSPEPINWVAIIQDDAVGEELGTDIQQRTDIALNNLTYIRKIKNIDTTIIISCLPNEGTLQPYQKTVITFCFTPKLMAVGKKDIGPSYRQDYALFLRFESVGSKDGFLRDDDYKTIKSERFQKVELALTGTGLPVLLQFDPGPVLNFKPCFMGERSEIQCIIKNQCELLPVTYHFKKTANFEIDPEKGKITGGGMVDVMCSFVPHQLGVFKVKQMIEIIGLVAEEDLQSLSVKSFHHVYLAFNSICKASTKKVVMKFDPGILPSIRNPTGKFVVKDLAKRKNYAPVAMLQSAMTRTHNHRSCEEPVKDMLLAFPNDRAATIRSKDHHKHFRPIFTKVPRFNYVNHDFAYTTFEKQQKKLHENYYAMYLKYLRSVRLQKKQAERERMYSYDDTDIGLEPGSGLKSPSLSEAEIEEELSSAANSIRANRLLTTRGIASQEEESVRRKVLKGLKSEPSTPQEKHDCSLMLTPKQIHQVIVGPSVLNFGNICVNSPNTHLLHVINMLPMHVLLQLDTDLEELQKTNQFSYVILPTSSTYISMVFDSPTIGKFWKSFTFTVNNVPSGHILVVAVVQPVTLELSSNELVLRPRGFFMKTCFRGTVRLYNRQNCCAQFQWQPVNTGRGIAFSICPAKGTVEAYSSLECEVTWQQGFSSPEEGEFILHVFQGNALKLKCVAHVIIFLEHGFCFEGYEFVGYTLVYIVTYI

SEQ ID NO: 17255 - protein, 502 aa, Homo sapiens
  Payload ID: 3475
  Gene Symbol: CFAP47
  Gene Name: cilia and flagella associated protein 47
  ENSP ID: ENSP00000324767
MAIHLDKQNIILKNDKDEYLKKTRDGVLPPYQDAKPPSPASIKKTYTTSKFNDAEPAKGNLFIGVEVLPENLHLDESETSEEDHGSLEKEKYEQFLSLEEGTKAHYFFEKVVNAAQTWFSLFGWPEGPHSFSIPETIRRDVYKMQFYSSTSPPQKFSRQNDFSKYNKTIYDVLLHLSGKMPPGINSSQSLPVDNHEKRVIQLHLQHSSLLDFLNAQGGCISHVLPEFLLEPEDYKRWIEIMSSTNTMPVSSCTPKKKCSIVIEMSKFEAWSKRAWTDVFLQIYKVLVLSRVVPYCSNNMPPICVQNTPKVNPCFASSNIYSDSERILLSWMNINYENTRHVIWKNCHKDVIPSERWIVNFDKDLSDGLVFATQLGAYCPFLIESHFINMYTRPKSPEEYLHNCLIIVNTLYEIDFDVEIQVCLRVFPKEMDAGVSGLRKEDMPSVWVVTIRLAVAVARTKRQKKGDIQFACFFVCLFFFIFVVISFSLWSRMHFFLLLPLDI

SEQ ID NO: 17256 - protein, 3187 aa, Homo sapiens
  Payload ID: 3475
  Gene Symbol: CFAP47
  Gene Name: cilia and flagella associated protein 47
  ENSP ID: ENSP00000367922
MNTQKGSLTINVHRGSLAMSIQRGSLVPRDMDSSGRDMQLRVIPAEVKFLDTMAGRVYRLPITVHNICRWNQKIRFKEPVKPQFKLMLTSLDKELASGLQMTAMVEYHPDKDEDTFDRLLISIENKTTEIPLIGLIPSCQLEIESVVNFGTLVANSKVYSKEITITNHGKAPGIFKAEYHGQLPILIFPTSGIVDAKSSMVIKVDFCADQPRIVDEEAIVILQGQPEMLLSIKAHVVEQIIELLSMSSDRRLECIHFGPVFFGSSKIKHARVYNNSPEPINWVAIIQDDAVGEELGTDIQQRTDIALNNLTYIRKIKNIDTTIIISCLPNEGTLQPYQKTVITFCFTPKLMAVGKKDIGPSYRQDYALFLRFESVGSKDGFLRDDDYKTIKSERFQKVELALTGTGLPVLLQFDPGPVLNFKPCFMGERSEIQCIIKNQCELLPVTYHFKKTANFEIDPEKGKITGGGMVDVMCSFVPHQLGVFKVKQMIEIIGLVAEEDLQSLSVKSFHHVYLAFNSICKASTKKVVMKFDPGILPSIRNPTGKFVVKDLAKRKNYAPVAMLQSAMTRTHNHRSCEEPVKDMLLAFPNDRAATIRSKDHHKHFRPIFTKVPRFNYVNHDFAYTTFEKQQKKLHENYYAMYLKYLRSVRLQKKQAERERMYSYDDTDIGLEPGSGLKSPSLSEAEIEEELSSAANSIRANRLLTTRGIASQEEESVRRKVLKGLKSEPSTPQEKHDCSLMLTPKQIHQVIVGPSVLNFGNICVNSPNTHLLHVINMLPMHVLLQLDTDLEELQKTNQFSYVILPTSSTYISMVFDSPTIGKFWKSFTFTVNNVPSGHILVVAVVQPVTLELSSNELVLRPRGFFMKTCFRGTVRLYNRQNCCAQFQWQPVNTGRGIAFSICPAKGTVEAYSSLECEVTWQQGFSSPEEGEFILHVFQGNALKLKCVAHLGRTKVLLLQPRILFSNCPQGLTTWRKAILQNVGQNHAYFKVCSQSLLPIINIIPSQGIVPFGGITVLNISCKPTVAEKFDTRAKVSIRHANVIDLRIGGSAEIADVEINPDVFNFSGAYIGGTQIIPFVIKNKGITRARVEFNLKDFPDFSMDLKDKSEEFKDPAVPYIYSLELEENTSLECSITFSPKEVTVVEFIIQVQINFFESSKLYTKYLSSSPSNPKTVPLIRPCYVQATALQSPLNLSSTKFVFEIPLHEMNPNNKVTKTQNLVLYNITKHHVTWTLDLSNTGKLFKDGTFKFSVLNGILRPNEKYNVSISFCPNRPGTYTADIPMLLNYIPVCYKILHLTGEVKSPELLFDPPFIFFTPVPLDITTVMDINILPQNYFRNSTLCVQIPTVRLLDGEEIHPLSVKFPKGRVIPGSHSGINNKLTCHLSFKSSKPVSFFTNLLFCDDRKNWFSLPVTATAENCILTIYPYMAIHLDKQNIILKNDKDEYLKKTRDGVLPPYQDAKPPSPASIKKTYTTSKFNDAEPAKGNLFIGVEVLPENLHLDESETSEEDHGSLEKEKYEQFLSLEEGTKAHYFFEKVVNAAQTWFSLFGWPEGPHSFSIPETIRRDVYKMQFYSSTSPPQKFSRQNDFSKYNKTIYDVLLHLSGKMPPGINSSQSLPVDNHEKRVIQLHLQHSSLLDFLNAQGGCISHVLPEFLLEPEDYKRWIEIMSSTNTMPVSSCTPKKKCSIVIEMSKFEAWSKRAWTDVFLQIYKVLVLSRVVPYCSNNMPPICVQNTPKVNPCFASSNIYSDSERILLSWMNINYENTRHVIWKNCHKDVIPSERWIVNFDKDLSDGLVFATQLGAYCPFLIESHFINMYTRPKSPEEYLHNCLIIVNTLYEIDFDVEIQATDICDPNPILMLMLCVYMYERLPTYLPKKVVSFECTLHDTVLNKILLKNSSSRNLVYNARIVGRDAADFSLSQKGNVVTISPRNEINVTLKFTSRFIRPAEASLLLISKPKNAVRGITMTFALKGKVLDFKAIDIIKCESPCYQFQEVTVNVKNPFHTAGDFSVILVESSTFVSSPTKLTESRQYPKHDDDMSSSGSDTDQGCSDSPNVLHTSIKSTFIREFFCSMHTVHLGVKGTSSLELRFLPFNMHVRYCVIILSNKKIGQLIYVAEGKGMTPLPSSCLPMNTSSSPVYYSTTREEGPNKKYPVLYLKCKPYQILYVDLKLPMTNEAKEKALAFAAQQQMSSIEYERRLITGTLESSSIRVAIALLGLTKIETLMLFRISKLRKPKTVSYTTEVSLPKYFYIPEKISIPWIPEPQVIKLSKAKASDGSVPLPLQFLPLQSGRYPCKILLKSRYDVRAYYVEGIVNEEQPEAKFEFETPAFEALTQNIPIKNQTNDKWTFQVTIEGEWFYGPVDLHVGPDEIVEYPLTFKPIFECVITGKLILQNEVDGREHIFDIKGVGKKPSALEHITVECQVGNVTQKHITLPHFTNTALTFKVTADLPIVWGNPQITVYPYKEILYLIHVRPWKRGILKGTITFSTTRRCTTRRKHDDYEEDTDQDQALSCLDSITEQSSILDDADTYGNFNNLRFWYNLEIHSTPGPPIEIMEMTCIALDSTCIEIPLSNPKDRGLHLEVQLTSAALNGDNEIILSPLQCTKYIVWYSPATTGYSDESIIFQPEMAEEFWYLLKLTIELPKPTTMPEIQCDLGKHVTQIIPLVNCTHETLKLQVTNSNPENFVLDINRKSQLIISPHSTTELPVLFYPSALGRADHQACINFYCTQFTEWKFYLSGVGLFPQPLDTERITTRIGLQSTIVIPFKNPTMEDVLIDIILTSVEHPRNLVMDHCWDSFIYESSAFRFSSPSEIQGIALPPKGNIDISLLFIPQIMKLHKTMVIIEMTKANGKYWPIDNFDELDIKFKSIVGIDSEEIQAIHWIYPIVGLPQAPPPKSPPVVIQCQSRKRAEEKVEIILNAGFFGFSLTPDLTEVLVIPKRNSHNFCEDPNEIPKIHEFEYEIQFESEAMKSKLESCVALYMIEKSYDIMAKRITFIFNLVFTPKKPLRSHITLKIECVTEGIWKFPIMLIATEPDTDAVIDIEGVGLFKESVFELRLKSQTRNPEPFTAHFLPGSDLEFFVKPQAGELLPFNTNGTLITVGFKPKMYCRKYKATLVIQTEEMYWKYEINGLTPTTVPPKNAKAKIDATHKTHDNMPVRPHNFVRENTKLIRTGVSSTIKGAPLVKNQ

SEQ ID NO: 17257 - protein, 633 aa, Homo sapiens
  Payload ID: 3475
  Gene Symbol: CFAP47
  Gene Name: cilia and flagella associated protein 47
  ENSP ID: ENSP00000367926
MEMTCIALDSTCIEIPLSNPKDRGLHLEVQLTSAALNGDNEIILSPLQCTKYIVWYSPATTGYSDESIIFQPEMAEEFWYLLKLTIELPKPTTMPEIQCDLGKHVTQIIPLVNCTHETLKLQVTNSNPENFVLDINRKSQLIISPHSTTELPVLFYPSALGRADHQACINFYCTQFTEWKFYLSGVGLFPQPLDTERITTRIGLQSTIVIPFKNPTMEDVLIDIILTSVEHPRNLVMDHCWDSFIYESSAFRFSSPSEIQGIALPPKGNIDISLLFIPQIMKLHKTMVIIEMTKANGKYWPIDNFDELDIKFKSIVGIDSEEIQAIHWIYPIVGLPQAPPPKSPPVVIQCQSRKRAEEKVEIILNAGFFGFSLTPDLTEVLVIPKRNSHNFCEDPNEIPKIHEFEYEIQFESEAMKSKLESCVALYMIEKSYDIMAKRITFIFNLVFTPKKPLRSHITLKIECVTEGIWKFPIMLIATEPDTDAVIDIEGVGLFKESVFELRLKSQTRNPEPFTAHFLPGSDLEFFVKPQAGELLPFNTNGTLITVGFKPKMYCRKYKATLVIQTEEMYWKYEINGLTPTTVPPKNAKAKIDATHKTHDNMPVRPHNFVRENTKLIRTGVSSTIKGAPLVKNQ

SEQ ID NO: 17258 - protein, 754 aa, Homo sapiens
  Payload ID: 3475
  Gene Symbol: CFAP47
  Gene Name: cilia and flagella associated protein 47
  ENSP ID: ENSP00000433564
MNTQKGSLTINVHRGSLAMSIQRGSLVPRDMDSSGRDMQLRVIPAEVKFLDTMAGRVYRLPITVHNICRWNQKIRFKEPVKPQFKLMLTSLDKELASGLQMTAMVEYHPDKDEDTFDRLLISIENKTTEIPLIGLIPSCQLEIESVVNFGTLVANSKVYSKEITITNHGKAPGIFKAEYHGQLPILIFPTSGIVDAKSSMVIKVDFCADQPRIVDEEAIVILQGQPEMLLSIKAHVVEQIIELLSMSSDRRLECIHFGPVFFGSSKIKHARVYNNSPEPINWVAIIQDDAVGEELGTDIQQRTDIALNNLTYIRKIKNIDTTIIISCLPNEGTLQPYQKTVITFCFTPKLMAVGKKDIGPSYRQDYALFLRFESVGSKDGFLRDDDYKTIKSERFQKVELALTGTGLPVLLQFDPGPVLNFKPCFMGERSEIQCIIKNQCELLPVTYHFKKTANFEIDPEKGKITGGGMVDVMCSFVPHQLGVFKVKQMIEIIGLVAEEDLQSLSVKSFHHVYLAFNSICKASTKKVVMKFDPGILPSIRNPTGKFVVKDLAKRKNYAPVAMLQSAMTRTHNHRSCEEPVKDMLLAFPNDRAATIRSKDHHKHFRPIFTKVPRFNYVNHDFAYTTFEKQQKKLHENYYAMYLKYLRSVRLQKKQAERERMYSYDDTDIGLEPGSGLKSPSLSEAEIEEELSSAANSIRANRLLTTRGIASQEEESVRRKVLKGLKSEPSTPQEKHDCSLMLTPKQIHQVIVVRY

SEQ ID NO: 17259 - protein, 90 aa, Homo sapiens
  Payload ID: 3475
  Gene Symbol: CFAP47
  Gene Name: cilia and flagella associated protein 47
  ENSP ID: ENSP00000485710
  MOD_RES (1)..(1): Any amino acid
XIPKIHEFEYEIQFESEAMKSKLESCVALYMIEKSYDIMAKRITFIFNLVFTPKKPLRNPEPFTAHFLPGSDLEFFVKPQAGELLPFNTN

SEQ ID NO: 17260 - protein, 620 aa, Homo sapiens
  Payload ID: 3476
  Gene Symbol: CFAP52
  Gene Name: cilia and flagella associated protein 52
  Uniprot ID: Q8N1V2
  ENSP ID: ENSP00000339449
MDNKISPEAQVAELELDAVIGFNGHVPTGLKCHPDQEHMIYPLGCTVLIQAINTKEQNFLQGHGNNVSCLAISRSGEYIASGQVTFMGFKADIILWDYKNRELLARLSLHKGKIEALAFSPNDLYLVSLGGPDDGSVVVWSIAKRDAICGSPAAGLNVGNATNVIFSRCRDEMFMTAGNGTIRVWELDLPNRKIWPTECQTGQLKRIVMSIGVDDDDSFFYLGTTTGDILKMNPRTKLLTDVGPAKDKFSLGVSAIRCLKMGGLLVGSGAGLLVFCKSPGYKPIKKIQLQGGITSITLRGEGHQFLVGTEESHIYRVSFTDFKETLIATCHFDAVEDIVFPFGTAELFATCAKKDIRVWHTSSNRELLRITVPNMTCHGIDFMRDGKSIISAWNDGKIRAFAPETGRLMYVINNAHRIGVTAIATTSDCKRVISGGGEGEVRVWQIGCQTQKLEEALKEHKSSVSCIRVKRNNEECVTASTDGTCIIWDLVRLRRNQMILANTLFQCVCYHPEEFQIITSGTDRKIAYWEVFDGTVIRELEGSLSGSINGMDITQEGVHFVTGGNDHLVKVWDYNEGEVTHVGVGHSGNITRIRISPGNQYIVSVSADGAILRWKYPYTS

SEQ ID NO: 17261 - protein, 552 aa, Homo sapiens
  Payload ID: 3476
  Gene Symbol: CFAP52
  Gene Name: cilia and flagella associated protein 52
  Uniprot ID: Q8N1V2
  ENSP ID: ENSP00000379521
MDNKISPEAQVAELELDAVIGFNDIILWDYKNRELLARLSLHKGKIEALAFSPNDLYLVSLGGPDDGSVVVWSIAKRDAICGSPAAGLNVGNATNVIFSRCRDEMFMTAGNGTIRVWELDLPNRKIWPTECQTGQLKRIVMSIGVDDDDSFFYLGTTTGDILKMNPRTKLLTDVGPAKDKFSLGVSAIRCLKMGGLLVGSGAGLLVFCKSPGYKPIKKIQLQGGITSITLRGEGHQFLVGTEESHIYRVSFTDFKETLIATCHFDAVEDIVFPFGTAELFATCAKKDIRVWHTSSNRELLRITVPNMTCHGIDFMRDGKSIISAWNDGKIRAFAPETGRLMYVINNAHRIGVTAIATTSDCKRVISGGGEGEVRVWQIGCQTQKLEEALKEHKSSVSCIRVKRNNEECVTASTDGTCIIWDLVRLRRNQMILANTLFQCVCYHPEEFQIITSGTDRKIAYWEVFDGTVIRELEGSLSGSINGMDITQEGVHFVTGGNDHLVKVWDYNEGEVTHVGVGHSGNITRIRISPGNQYIVSVSADGAILRWKYPYTS

SEQ ID NO: 17262 - protein, 42 aa, Homo sapiens
  Payload ID: 3476
  Gene Symbol: CFAP52
  Gene Name: cilia and flagella associated protein 52
  ENSP ID: ENSP00000458343
MDNKISPEAQVAELELDAVIGFNGPVLLKLFLVNKLPTQAKQ

SEQ ID NO: 17263 - protein, 31 aa, Homo sapiens
  Payload ID: 3476
  Gene Symbol: CFAP52
  Gene Name: cilia and flagella associated protein 52
  ENSP ID: ENSP00000458398
MDNKISPEAQVAELELDAVIGFNGRHHFVGL

SEQ ID NO: 17264 - protein, 48 aa, Homo sapiens
  Payload ID: 3476
  Gene Symbol: CFAP52
  Gene Name: cilia and flagella associated protein 52
  ENSP ID: ENSP00000459347
MDNKISPEAQVAELELDAVIGFNVGQFEYGNWIFQIEKSGQLSAKQDS

SEQ ID NO: 17265 - protein, 31 aa, Homo sapiens; identical to SEQ ID NO: 17263
  Payload ID: 3476
  Gene Symbol: CFAP52
  Gene Name: cilia and flagella associated protein 52
  ENSP ID: ENSP00000459671

SEQ ID NO: 17266 - protein, 93 aa, Homo sapiens
  Payload ID: 3476
  Gene Symbol: CFAP52
  Gene Name: cilia and flagella associated protein 52
  ENSP ID: ENSP00000468193
  MOD_RES (1)..(1): Any amino acid
XTQKLEEALKEHKSSVSCIRVKRNNEECVTASTDGTCIIWDLVRLRRNQMILANTLFQCVCYHPEEFQIITSGTDRKVEMTIWSKFGIIMRVK

SEQ ID NO: 17267 - protein, 127 aa, Homo sapiens
  Payload ID: 3476
  Gene Symbol: CFAP52
  Gene Name: cilia and flagella associated protein 52
  ENSP ID: ENSP00000476293
MDNKISPEAQVAELELDAVIGFNGHVPTGLKCHPDQEHMIYPLGCTVLIQAINTKEQNFLQGHGNNVSCLAISRSGEYIASGQVTFMGFKTSFCGIIRTESCLLGCPFTKAKLKLWPFLQMICTWYH

SEQ ID NO: 17268 - protein, 514 aa, Homo sapiens
  Payload ID: 3477
  Gene Symbol: CFAP53
  Gene Name: cilia and flagella associated protein 53
  Uniprot ID: Q96M91
  ENSP ID: ENSP00000381553
MYSQRFGTVQREVKGPTPKVVIVRSKPPKGQGAEHHLERIRRSHQKHNAILASIKSSERDRLKAEWDQHNDCKILDSLVRARIKDAVQGFIINIEERRNKLRELLALEENEYFTEMQLKKETIEEKKDRMREKTKLLKEKNEKERQDFVAEKLDQQFRERCEELRVELLSIHQKKVCEERKAQIAFNEELSRQKLVEEQMFSKLWEEDRLAKEKREAQEARRQKELMENTRLGLNAQITSIKAQRQATQLLKEEEARLVESNNAQIKHENEQDMLKKQKAKQETRTILQKALQERIEHIQQEYRDEQDLNMKLVQRALQDLQEEADKKKQKREDMIREQKIYHKYLAQRREEEKAQEKEFDRILEEDKAKKLAEKDKELRLEKEARRQLVDEVMCTRKLQVQEKLQREAKEQEERAMEQKHINESLKELNCEEKENFARRQRLAQEYRKQLQMQIAYQQQSQEAEKEEKRREFEAGVAANKMCLDKVQEVLSTHQVLPQNIHPMRKACPSKLPP

SEQ ID NO: 17269 - protein, 1250 aa, Homo sapiens
  Payload ID: 3478
  Gene Symbol: CFAP57
  Gene Name: cilia and flagella associated protein 57
  Uniprot ID: Q96MR6
  ENSP ID: ENSP00000361570
MSAVVAQTLHVFGLRSHVANNIFYFDEQIIIFPSGNHCVKYNVDQKWQKFIPGSEKSQGMLALSISPNRRYLAISETVQEKPAITIYELSSIPCRKRKVLNNFDFQVQKFISMAFSPDSKYLLAQTSPPESNLVYWLWEKQKVMAIVRIDTQNNPVYQVSFSPQDNTQVCVTGNGMFKLLRFAEGTLKQTSFQRGEPQNYLAHTWVADDKIVVGTDTGKLFLFESGDQRWETSIMVKEPTNGSKSLDVIQESESLIEFPPVSSPLPSYEQMVAASSHSQMSMPQVFAIAAYSKGFACSAGPGRVLLFEKMEEKDFYRESREIRIPVDPQSNDPSQSDKQDVLCLCFSPSEETLVASTSKNQLYSITMSLTEISKGEPAHFEYLMYPLHSAPITGLATCIRKPLIATCSLDRSIRLWNYETNTLELFKEYQEEAYSISLHPSGHFIVVGFADKLRLMNLLIDDIRSFKEYSVRGCGECSFSNGGHLFAAVNGNVIHVYTTTSLENISSLKGHTGKIRSIVWNADDSKLISGGTDGAVYEWNLSTGKRETECVLKSCSYNCVTVSPDAKIIFAVGSDHTLKEIADSLILREISAFDVTYTAIVISHSGRMMFVGTSVGTIRAMKYPLPLQKEFNEYQAHAGPITKMLLTFDDQFLLTAAEDGCLFTWKVFDKDGRGIKREREVGFAEEVLVTKTDMEEKAQVMLELKTRVEELKMENEYQLRLKDMNYSEKIKELTDKFIQEMESLKTKNQVLRTEKEKQDVYHHEHIEDLLDKQSRELQDMECCNNQKLLLEYEKYQELQLKSQRMQEEYEKQLRDNDETKSQALEELTEFYEAKLQEKTTLLEEAQEDVRQQLREFEETKKQIEEDEDREIQDIKTKYEKKLRDEKESNLRLKGETGIMRKKFSSLQKEIEERTNDIETLKGEQMKLQGVIKSLEKDIQGLKREIQERDETIQDKEKRIYDLKKKNQELGKFKFVLDYKIKELKKQIEPRENEIRVMKEQIQEMEAELENFHKQNTQLELNITELWQKLRATDQEMRRERQKERDLEALVKRFKTDLHNCVAYIQEPRLLKEKVRGLFEKYVQRADMVEIAGLNTDLQQEYTRQREHLERNLATLKKKVVKEGELHRTDYVRIMQENVSLIKEINELRRELKFTRSQVYDLEAALKLTKKVRPQEVSETEPSRDMLSTAPTARLNEQEETGRIIEMQRLEIQRLRDQIQEQEQVTGFHTLAGVRLPSLSNSEVDLEVKTN

SEQ ID NO: 17270 - protein, 78 aa, Homo sapiens
  Payload ID: 3478
  Gene Symbol: CFAP57
  Gene Name: cilia and flagella associated protein 57
  ENSP ID: ENSP00000416933
  MOD_RES (1)..(1): Any amino acid
XEREVGFAEEVLVTKTDMEEKAQVMLELKTRVEELKMENEYQLRLKDMNYSEKIKELTDKFIQEMESLKTKNQVCLRD

SEQ ID NO: 17271 - protein, 63 aa, Homo sapiens
  Payload ID: 3478
  Gene Symbol: CFAP57
  Gene Name: cilia and flagella associated protein 57
  ENSP ID: ENSP00000432547
MSAVVAQTLHVFGLRSHVANNIFYFDEQIIIFPSGNHCVKYNVDQKWQKFIPGSFWLLYRGQI

SEQ ID NO: 17272 - protein, 166 aa, Homo sapiens
  Payload ID: 3478
  Gene Symbol: CFAP57
  Gene Name: cilia and flagella associated protein 57
  ENSP ID: ENSP00000434133
MSAVVAQTLHVFGLRSHVANNIFYFDEQIIIFPSGNHCVKYNVDQKWQKFIPGSEKSQGMLALSISPNRRYLAISETVQEKPAITIYELSSIPCRKRKVLNNFDFQVQKFISMAFSPDSKYLLAQTSPPESNLVYWLWEKQKVMAIVRIDTQNNPVYQVSFSPQDN

SEQ ID NO: 17273 - protein, 63 aa, Homo sapiens; identical to SEQ ID NO: 17271
  Payload ID: 3478
  Gene Symbol: CFAP57
  Gene Name: cilia and flagella associated protein 57
  ENSP ID: ENSP00000434671

SEQ ID NO: 17274 - protein, 698 aa, Homo sapiens
  Payload ID: 3478
  Gene Symbol: CFAP57
  Gene Name: cilia and flagella associated protein 57
  Uniprot ID: Q96MR6
  ENSP ID: ENSP00000435310
MSAVVAQTLHVFGLRSHVANNIFYFDEQIIIFPSGNHCVKYNVDQKWQKFIPGSEKSQGMLALSISPNRRYLAISETVQEKPAITIYELSSIPCRKRKVLNNFDFQVQKFISMAFSPDSKYLLAQTSPPESNLVYWLWEKQKVMAIVRIDTQNNPVYQVSFSPQDNTQVCVTGNGMFKLLRFAEGTLKQTSFQRGEPQNYLAHTWVADDKIVVGTDTGKLFLFESGDQRWETSIMVKEPTNGSKSLDVIQESESLIEFPPVSSPLPSYEQMVAASSHSQMSMPQVFAIAAYSKGFACSAGPGRVLLFEKMEEKDFYRESREIRIPVDPQSNDPSQSDKQDVLCLCFSPSEETLVASTSKNQLYSITMSLTEISKGEPAHFEYLMYPLHSAPITGLATCIRKPLIATCSLDRSIRLWNYETNTLELFKEYQEEAYSISLHPSGHFIVVGFADKLRLMNLLIDDIRSFKEYSVRGCGECSFSNGGHLFAAVNGNVIHVYTTTSLENISSLKGHTGKIRSIVWNADDSKLISGGTDGAVYEWNLSTGKRETECVLKSCSYNCVTVSPDAKIIFAVGSDHTLKEIADSLILREISAFDVTYTAIVISHSGRMMFVGTSVGTIRAMKYPLPLQKEFNEYQAHAGPITKVSRALSPGTQSHTCLLRALFIPSTSQCLFSLLLLSYLFIHHSLNHHLLTMNILFV

SEQ ID NO: 17275 - protein, 1283 aa, Homo sapiens
  Payload ID: 3478
  Gene Symbol: CFAP57
  Gene Name: cilia and flagella associated protein 57
  ENSP ID: ENSP00000479773
MSAVVAQTLHVFGLRSHVANNIFYFDEQIIIFPSGNHCVKYNVDQKWQKFIPGSEKSQGMLALSISPNRRYLAISETVQEKPAITIYELSSIPCRKRKVLNNFDFQVQKFISMAFSPDSKYLLAQTSPPESNLVYWLWEKQKVMAIVRIDTQNNPVYQVSFSPQDNTQVCVTGNGMFKLLRFAEGTLKQTSFQRGEPQNYLAHTWVADDKIVVGTDTGKLFLFESGDQRWETSIMVKEPTNGSKSLDVIQESESLIEFPPVSSPLPSYEQMVAASSHSQMSMPQVFAIAAYSKGFACSAGPGRVLLFEKMEEKDFYRESREIRIPVDPQSNDPSQSDKQDVLCLCFSPSEETLVASTSKNQLYSITMSLTEISKGEPAHFEYLMYPLHSAPITGLATCIRKPLIATCSLDRSIRLWNYETNTLELFKEYQEEAYSISLHPSGHFIVVGFADKLRLMNLLIDDIRSFKEYSVRGCGECSFSNGGHLFAAVNGNVIHVYTTTSLENISSLKGHTGKIRSIVWNADDSKLISGGTDGAVYEWNLSTGKRETECVLKSCSYNCVTVSPDAKIIFAVGSDHTLKEIADSLILREISAFDVTYTAIVISHSGRMMFVGTSVGTIRAMKYPLPLQKEFNEYQAHAGPITKMLLTFDDQFLLTAAEDGCLFTWKVFDKDGRGIKREREVGFAEEVLVTKTDMEEKAQVMLELKTRVEELKMENEYQLRLKDMNYSEKIKELTDKFIQEMESLKTKNQVLRTEKEKQDVYHHEHIEDLLDKQSRELQDMECCNNQKLLLEYEKYQELQLKSQRMQEEYEKQLRDNDETKSQALEELTEFYEAKLQEKTTLLEEAQEDVRQQLREFEETKKQIEEDEDREIQDIKTKYEKKLRDEKESNLRLKGETGIMRKKFSSLQKEIEERTNDIETLKGEQMKLQGVIKSLEKDIQGLKREIQERDETIQDKEKRIYDLKKKNQELGKFKFVLDYKIKELKKQIEPRENEIRVMKEQIQENDPILKWPQRVEIHLYNFRKQVRKVLLWGTLPQMEAELENFHKQNTQLELNITELWQKLRATDQEMRRERQKERDLEALVKRFKTDLHNCVAYIQEPRLLKEKVRGLFEKYVQRADMVEIAGLNTDLQQEYTRQREHLERNLATLKKKVVKEGELHRTDYVRIMQENVSLIKEINELRRELKFTRSQVYDLEAALKLTKKVRPQEVSETEPSRDMLSTAPTARLNEQEETGRIIEMQRLEIQRLRDQIQEQEQVTGFHTLAGVRLPSLSNSEVDLEVKTN

SEQ ID NO: 17276 - protein, 92 aa, Homo sapiens
  Payload ID: 3479
  Gene Symbol: CFAP58
  Gene Name: cilia and flagella associated protein 58
  ENSP ID: ENSP00000358717
MDELLRERDILNKNMLKAVNATQKQTDLVKLHEQAKRNLEGEIQNYKDEAQKQRKIIFHLEKERDRYINQASDLTQKADSVRMPWPLDKGKW

SEQ ID NO: 17277 - protein, 872 aa, Homo sapiens
  Payload ID: 3479
  Gene Symbol: CFAP58
  Gene Name: cilia and flagella associated protein 58
  Uniprot ID: Q5T655
  ENSP ID: ENSP00000358718
MAEEKGGKQVLEESAFEEMERDFQGVLHELSGDKSLEKFRIEYERLHAVMKKSYDNEKRLMAKCRELNAEIVVNSAKVATALKLSQDDQTTIASLKKEIEKAWKMVDSAYDKEQKAKETILALKEEIVNLTKLVEQGSGLSMDQHSNIRDLLRFKEEVTKERDQLLSEVVKLRESLAQTTEQQQETERSKEEAEHAISQFQQEIQQRQNEASREFRKKEKLEKELKQIQADMDSRQTEIKALQQYVQKSKEELQKLEQQLKEQKILNERAAKELEQFQMRNAKLQQENEQHSLVCEQLSQENQQKALELKAKEEEVHQMRLDIGKLNKIREQIHKKLHHTEDQKAEVEQHKETLKNQIVGLEREVEASKKQAELDRKAMDELLRERDILNKNMLKAVNATQKQTDLVKLHEQAKRNLEGEIQNYKDEAQKQRKIIFHLEKERDRYINQASDLTQKVLMNMEDIKVRETQIFDYRKKIAESEIKLKQQQNLYEAVRSDRNLYSKNLVEAQDEITDMKRKLKIMIHQVDELKEDISAKESALVKLHLEQQRIEKEKETLKAELQKLRQQALETKHFIEKQEAEERKLLRIIAEADGERLRQKKELDQVISERDILGSQLVRRNDELALLYEKIKIQQSVLNKGESQYNQRLEDMRILRLEIKKLRREKGILARSMANVEELRQEFFHMQRELLKERTRCRALEEELENPLNVHRWRKLEASDPNAYELIQKIHTLQKRLISKTEEVVEKELLLQEKEKLYMELKHVLARQPGPEAAEQLKLYRRTLHDKKQQLKVLSSELNMYEVQSKEYKYEVEKLTNELQNLKKKYLAQKRKEQLQKNKDTAPMDNTFLMVKPNGPGFTGGGFPLRSTKMTF

SEQ ID NO: 17278 - protein, 1237 aa, Homo sapiens
  Payload ID: 3480
  Gene Symbol: CFAP61
  Gene Name: cilia and flagella associated protein 61
  Uniprot ID: Q8NHU2
  ENSP ID: ENSP00000245957
MSVLTSPRGKVEVVHCRRTESQDVYCIKSLIRKFTCKLFGKLNIIYLLEKANLAVTLCNDKEEIMAQATFLDYPNWNVAKQDDWVSVFRELDSDIPCTPLNTLFMHLFVAVDEYSVGCCKEILRTVYKAVPELHFIFLIVPSYMSLGSTLITVFDQVGNIPCLTYEEDFAVHICHRHSHYPQLHVRKARVEDHDDLMPIFMRYDTILKETYGEYFLAELIEAQDEENHAVVCEVEGTAVGFMSVCSRVNMQLLHECFDLGPFHGLCFPHPDDVLESPQDLSVRRSQDAELRSSSQGSQKIVEELQEPVSPDTMENIQGNIAREAASEEALTAVQSGNVSEPEDIEKLSDISTGYAQYHHVSSRSLASLVLPEEPVHFRPIYRGASAAFCIQLFCIDEKYEARSLDFMNFVFSLFSDKNFCVISLPHLTPEFFLIQNFVKMVPFNTCTLEQDLYVFHRAGLLKSINIRFATLLDTPGVENLVSTLMLNKSILEDLDRYNKARKDPDGTLLQAFVAEVAEQIVGIAVIRNEMDIEYIRSHYNIEDFIYFSHHQREEHGHMHHFALNPIFRHYTKFFLKEILRLGFKSCLYYRVYPKSREGKFQNPYAHSLTSALHYLVPVRPRRQIVYPLEKLGINAPSKAVSKDPMSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEGNIIVYGNTIDTYTTVETLLNLGVSGSRIHLVQPPPASTITCINNYSVESAVADALGAAGVTMYRDAILAQWNDGLHPDPIYSASFTTPTKPFRLQCSMFFSFCEKNVDYETFKALNDACLVYDSRLVIDTNFHTNDIAIRAAGSLTKFSNRYYSNEWTHSNFSSKEIGFQLAAAMLHLFDPTLEPVTEPPANLDRLIPMYKGAKIQGGILPGSYHYLHIAKPAIPTPLEVQMAQPNYGLELVTGSAKNGTYFRIHINKYKMVETITCLSREPFPASNYIRLFGQHEQLLNNLCARYDENLITDLYSYFTEPWCLALFHDRFIDLRKELRQILASKEEEDLPSIEQLAHQIEDEEINPTEKPRQYLKRVFEESIYKTLVERSTLDYLHYNRYHLPMYAWPGIV

SEQ ID NO: 17279 - protein, 370 aa, Homo sapiens
  Payload ID: 3480
  Gene Symbol: CFAP61
  Gene Name: cilia and flagella associated protein 61
  ENSP ID: ENSP00000345553
MREKANLAVTLCNDKEEIMAQATFLDYPNWNVAKQDDWVSVFRELDSDIPCTPLNTLFMHLFVAVDEYSVGCCKEILRTVYKAVPELHFIFLIVPSYMSLGSTLITVFDQVGNIPCLTYEEDFAVHICHRHSHYPQLHVRKARVEDHDDLMPIFMRYDTILKETYGEYFLAELIEAQDEENHAVVCEVEGTAVGFMSVCSRVNMQLLHECFDLGPFHGLCFPHPDDVLESPQDLSVRRSQDAELRSSSQGSQKIVEELQEPVSPDTMENIQGNIAREAASEEALTAVQSGNVSEPEDIEKLSDISTGYAQYHHVSSRSLASLVLPEEPVHFRPIYRGASAAFCIQLFCIDEKYEARSLDFMNFVFSLFSV

SEQ ID NO: 17280 - protein, 200 aa, Homo sapiens
  Payload ID: 3480
  Gene Symbol: CFAP61
  Gene Name: cilia and flagella associated protein 61
  Uniprot ID: Q8NHU2
  ENSP ID: ENSP00000366508
MSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEDGGRASVLFC

SEQ ID NO: 17281 - protein, 189 aa, Homo sapiens
  Payload ID: 3480
  Gene Symbol: CFAP61
  Gene Name: cilia and flagella associated protein 61
  ENSP ID: ENSP00000366518
MSVLTSPRGKVEVVHCRRTESQDVYCIKSLIRKFTCKLFGKLNIIYLLEKANLAVTLCNDKEEIMAQATFLDYPNWNVAKQDDWVSVFRELDSDIPCTPLNTLFMHLFVAVDEYSVGCCKEILRTVYKAVPELHFIFLIVPSYMSLGSTLITVFDQVGNIPCLTYEEDFAVHICHRHSHYPQLHVRKAR

SEQ ID NO: 17282 - protein, 470 aa, Homo sapiens
  Payload ID: 3480
  Gene Symbol: CFAP61
  Gene Name: cilia and flagella associated protein 61
  Uniprot ID: Q8NHU2
  ENSP ID: ENSP00000366521
MSVLTSPRGKVEVVHCRRTESQDVYCIKSLIRKFTCKLFGKLNIIYLLEKANLAVTLCNDKEEIMAQATFLDYPNWNVAKQDDWVSVFRELDSDIPCTPLNTLFMHLFVAVDEYSVGCCKEILRTVYKAVPELHFIFLIVPSYMSLGSTLITVFDQVGNIPCLTYEEDFAVHICHRHSHYPQLHVRKARVEDHDDLMPIFMRYDTILKETYGEYFLAELIEAQDEENHAVVCEVEGTAVGFMSVCSRVNMQLLHECFDLGPFHGLCFPHPDDVLESPQDLSVRRSQDAELRSSSQGSQKIVEELQEPVSPDTMENIQGNIAREAASEEALTAVQSGNVSEPEDIEKLSDISTGYAQYHHVSSRSLASLVLPEEPVHFRPIYRGASAAFCIQLFCIDEKYEARSLDFMNFVFSLFSDKNFCVISLPHLTPEFFLIQNFVKMVPFNTCTLEQDLYVFHRAGLLKNICLGRSS

SEQ ID NO: 17283 - protein, 320 aa, Homo sapiens
  Payload ID: 3480
  Gene Symbol: CFAP61
  Gene Name: cilia and flagella associated protein 61
  Uniprot ID: Q8NHU2
  ENSP ID: ENSP00000366523
MSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEGNIIVYGNTIDTYTTVETLLNLGVSGSRIHLVQPPPASTITCINNYSVESAVADALGAAGVTMYRDAILAQWNDGLHPDPIYSASFTTPTKPFRLQCSGAFFLGLTIICILPSLPFQLPWRYKWHSLIMV

SEQ ID NO: 17284 - protein, 200 aa, Homo sapiens; identical to SEQ ID NO: 17280
  Payload ID: 3480
  Gene Symbol: CFAP61
  Gene Name: cilia and flagella associated protein 61
  Uniprot ID: Q8NHU2
  ENSP ID: ENSP00000374307

SEQ ID NO: 17285 - protein, 227 aa, Homo sapiens
  Payload ID: 3480
  Gene Symbol: CFAP61
  Gene Name: cilia and flagella associated protein 61
  ENSP ID: ENSP00000388074
  MOD_RES (1)..(1): Any amino acid
XNFVKMVPFNTCTLEQDLYVFHRAGLLKSINIRFATLLDTPGVENLVSTLMLNKSILEDLDRYNKARKDPDIEYIRSHYNIEDFIYFSHHQREEHGHMHHFALNPIFRHYTKFFLKEILRLGFKSCLYYRVYPKSREGKFQNPYAHSLTSALHYLVPVRPRRQIVYPLEKLGINAPSKAVSKDPMSYALNHTNRKLTLEPKITVNAKIIVVGASSVGISFLETLVFW

SEQ ID NO: 17286 - protein, 67 aa, Homo sapiens
  Payload ID: 3480
  Gene Symbol: CFAP61
  Gene Name: cilia and flagella associated protein 61
  ENSP ID: ENSP00000397311
MSVCSRVNMQLLHECFDLGPFHGLCFPHPDDVLESPQDLSVRRSQETRSHFVAQAGVQWCKYGSLQP

SEQ ID NO: 17287 - protein, 470 aa, Homo sapiens; identical to SEQ ID NO: 17282
  Payload ID: 3480
  Gene Symbol: CFAP61
  Gene Name: cilia and flagella associated protein 61
  Uniprot ID: Q8NHU2
  ENSP ID: ENSP00000414537

SEQ ID NO: 17288 - protein, 135 aa, Homo sapiens
  Payload ID: 3480
  Gene Symbol: CFAP61
  Gene Name: cilia and flagella associated protein 61
  ENSP ID: ENSP00000417086
MSVLTSPRGKVEVVHCRRTESQDVYCIKSLIRKFTCKLFGKLNIIYLLEKANLAVTLCNDKEEIMAQATFLDYPNWNVAKQDDWVSVFRELDSDIPCTPLNTLFMHLFVAVDEYSVGCCKEILRTVYKAVPELHF

SEQ ID NO: 17289 - protein, 55 aa, Homo sapiens
  Payload ID: 3480
  Gene Symbol: CFAP61
  Gene Name: cilia and flagella associated protein 61
  ENSP ID: ENSP00000420438
MSVLTSPRGKVEVVHCRRTESQDVYCIKSLIRKFTCKLFGKLNIIYLLFSRSCLH

SEQ ID NO: 17290 - protein, 160 aa, Homo sapiens
  Payload ID: 3480
  Gene Symbol: CFAP61
  Gene Name: cilia and flagella associated protein 61
  ENSP ID: ENSP00000420498
MHLFVAVDEYSVGCCKEILRTVYKAVPELHFIFLIVPSYMSLGSTLITVFDQVGNIPCLTYEEDFAVHICHRHSHYPQLHVRKARVEDHDDLMPIFMRYDTILKETYGEYFLAELIEAQDEENHAVVCEVEGTAVGFMSVCSRVNMQLLHECFDLGPFHG

SEQ ID NO: 17291 - protein, 941 aa, Homo sapiens
  Payload ID: 3481
  Gene Symbol: CFAP69
  Gene Name: cilia and flagella associated protein 69
  Uniprot ID: A5D8W1
  ENSP ID: ENSP00000373948
MWTEEAGATAEAQESGIRNKSSSSSQIPVVGVVTEDDEAQDVFKPMDLNRVIKLLEETDKDGLEEKQLKFVKKLVQCYQNGLPLRDLAQIFKILNLCSGKIKNQPRFIESAYDIIKLCGLPFLKKKVSDEITYAEDTANSIALLGDLMKIPSSELRIQICKCIVDFYHAEPPKKHIPGYQQASSSYKIQMAEVGGLAKTMVQSMTLLENQLVEKLWVLKVLQHLSTSEVNCTIMMKAQAASGICTHLNDPDPSGQLLFRSSEILWNLLEKSSKEEVIQQLSNLECLLALKEVFKNLFMRGFSHYDRQLRNDILVITTIIAQNPEAPMIECGFTKDLILFATFNEVKSQNLLVKGLKLSNSYEDFELKKLLFNVIVILCKDLPTVQLLIDGKVILALFTYVKKPEKQKIIDWSAAQHEELQLHAIATLSSVAPLLIEEYMSCQGNARVLAFLEWCESEDPFFSHGNSFHGTGGRGNKFAQMRYSLRLLRAVVYLEDETVNKDLCEKGTIQQMIGIFKNIISKPNEKEEAIVLEIQSDILLILSGLCENHIQRKEIFGTEGVDIVLHVMKTDPRKLQSGLGYNVLLFSTLDSIWCCILGCYPSEDYFLEKEGIFLLLDLLALNQKKFCNLILGIMVEFCDNPKTAAHVNAWQGKKDQTAASLLIKLWRKEEKELGVKRDKNGKIIDTKKPLFTSFQEEQKIIPLPANCPSIAVMDVSENIRAKIYAILGKLDFENLPGLSAEDFVTLCIIHRYLDFKIGEIWNEIYEEIKLEKLRPVTTDKKALEAITTASENIGKMVASLQSDIIESQACQDMQNEQKVYAKIQATHKQRELANKSWEDFLARTSNAKTLKKAKSLQEKAIEASRYHKRPQNAIFHQTHIKGLNTTVPSGGVVTVESTPARLVGGPLVDTDIALKKLPIRGGALQRVKAVKIVDAPKKSIPT

SEQ ID NO: 17292 - protein, 478 aa, Homo sapiens
  Payload ID: 3481
  Gene Symbol: CFAP69
  Gene Name: cilia and flagella associated protein 69
  ENSP ID: ENSP00000391571
ELQLHAIATLSSVAPLLIEEYMSCQGNARVLAFLEWCESEDPFFSHGNSFHGTGGRGNKFAQMRYSLRLLRAVVYLEDETVNKDLCEKGTIQQMIGIFKNIISKPNEKEEAIVLEIQSDILLILSGLCENHIQRKEIFGTEGVDIVLHVMKTDPRKLQSGLGYNVLLFSTLDSIWCCILGCYPSEDYFLEKEGIFLLLDLLALNQKKFCNLILGIMVEFCDNPKTAAHVNAWQGKKDQTAASLLIKLWRKEEKELGVKRDKNGKIIDFENLPGLSAEDFVTLCIIHRYLDFKIGEIWNEIYEEIKLEKLRPVTTDKKALEAITTASENIGKMVASLQSDIIESQACQDMQNEQKVYAKIQATHKQRELANKSWEDFLARTSNAKTLKKAKSLQEKAIEASRYHKRPQNAIFHQTHIKGLNTTVPSGGVVTVESTPARLVGGPLVDTDIALKKLPIRGGALQRVKAVKIVDAPKKSIPT

SEQ ID NO: 17293 - protein, 515 aa, Homo sapiens
  Payload ID: 3481
  Gene Symbol: CFAP69
  Gene Name: cilia and flagella associated protein 69
  ENSP ID: ENSP00000392365
DGLEEKQLKFVKKLVQCYQNGLPLRDLAQIFKILNLCSGKIKNQPRFIESAYDIIKLCGLPFLKKKVSDEITYAEDTANSIALLGDLMKIPSSELRIQICKCIVDFYHAEPPKKHIPGYQQASSSYKIQMAEVGGLAKTMVQSMTLLENQLVEKLWVLKVLQHLSTSEVNCTIMMKAQAASGICTHLNDPDPSGQLLFRSSEILWNLLEKSSKEEVIQQLSNLECLLALKEVFKNLFMRGFSHYDRQLRNDILVITTIIAQNPEAPMILLIDGKVILALFTYVKKPEKQKIIDWSAAQHEELQLHAIATLSSVAPLLIEEYMSCQGNARVLAFLEWCESEDPFFSHGNSFHGTGGRGNKFAQMRYSLRLLRAVVYLEDETVNKDLCEKGTIQQMIGIFKNIISKPNEKEEAIVLEIQSDILLILSGLCENHIQRKEIFGTEGVDIVLHVMKTDPRKLQSGLGYNVLLFSTLDSIWCCILGCYPSEDYFLEKEGIFLLLDLLAKDQTAASLLIKLW

SEQ ID NO: 17294 - protein, 89 aa, Homo sapiens
  Payload ID: 3481
  Gene Symbol: CFAP69
  Gene Name: cilia and flagella associated protein 69
  ENSP ID: ENSP00000393339
  MOD_RES (1)..(1): Any amino acid
XMVQSMTLLENQLVEKLWVLKVLQHLSTSEVNCTIMMKAQAASGICTHLNDPDPSGQLLFRSSEILWNLLEKSSKEEVIQQLSNLECLL

SEQ ID NO: 17295 - protein, 119 aa, Homo sapiens
  Payload ID: 3481
  Gene Symbol: CFAP69
  Gene Name: cilia and flagella associated protein 69
  ENSP ID: ENSP00000411143
MWTEEAGATAEAQESGIRNKSSSSSQIPVVGVVTEDDEAQDVFKPMDLNRVIKLLEETDKDGLEEKQLKFVKKLVQCYQNGLPLRDLAQIFKILNLCSGKIKNQPRFIESAYDIIKLCG

SEQ ID NO: 17296 - protein, 229 aa, Homo sapiens
  Payload ID: 3481
  Gene Symbol: CFAP69
  Gene Name: cilia and flagella associated protein 69
  Uniprot ID: A5D8W1
  ENSP ID: ENSP00000411234
MWTEEAGATAEAQESGIRNKSSSSSQIPVVGVVTEDDEAQDVFKPMDLNRVIKLLEETDKDGLEEKQLKFVKKLVQCYQNGLPLRDLAQIFKILNLCSGKIKNQPRFIESAYDIIKLCGLPFLKKKVSDEITYAEDTANSIALLGDLMKIPSSELRIQICKCIVDFYHAEPPKKHIPGYQQASSSYKIQMAEVGGLAKTMVQSMTLLENQLVEKLWVLKVLQHLSTSGL

SEQ ID NO: 17297 - protein, 93 aa, Homo sapiens
  Payload ID: 3481
  Gene Symbol: CFAP69
  Gene Name: cilia and flagella associated protein 69
  ENSP ID: ENSP00000414772
  MOD_RES (1)..(1): Any amino acid
XEQKVYAKIQATHKQRELANKSWEDFLARTSNAKTLKVPSGGVVTVESTPARLVGGPLVDTDIALKKLPIRGGALQRVKAVKIVDAPKKSIPT

SEQ ID NO: 17298 - protein, 170 aa, Homo sapiens
  Payload ID: 3481
  Gene Symbol: CFAP69
  Gene Name: cilia and flagella associated protein 69
  ENSP ID: ENSP00000415818
  MOD_RES (1)..(1): Any amino acid
XPSIAVMDVSENIRAKIYAILGKLDFENLPGLSAEDFVTLCIIHRYLDFKIQATHKQRELANKSWEDFLARTSNAKTLKKAKSLQEKAIEASRYHKRPQNAIFHQTHIKGLNTTVPSGGVVTVESTPARLVGGPLVDTDIALKKLPIRGGALQRVKAVKIVDAPKKSIPT

SEQ ID NO: 17299 - protein, 923 aa, Homo sapiens
  Payload ID: 3481
  Gene Symbol: CFAP69
  Gene Name: cilia and flagella associated protein 69
  Uniprot ID: A5D8W1
  ENSP ID: ENSP00000419549
MWTEEAGATAEAQESGIRNKSSSSSQIPVVGVVTEDDEAQDVFKPMDLNRVIKLLEETDKDGLEEKQLKFVKKLVQCYQNGLPLRDLAQIFKILNLCSGKIKNQPRFIESAYDIIKLCGLPFLKKKVSDEITYAEDTANSIALLGDLMKIPSSELRIQICYQQASSSYKIQMAEVGGLAKTMVQSMTLLENQLVEKLWVLKVLQHLSTSEVNCTIMMKAQAASGICTHLNDPDPSGQLLFRSSEILWNLLEKSSKEEVIQQLSNLECLLALKEVFKNLFMRGFSHYDRQLRNDILVITTIIAQNPEAPMIECGFTKDLILFATFNEVKSQNLLVKGLKLSNSYEDFELKKLLFNVIVILCKDLPTVQLLIDGKVILALFTYVKKPEKQKIIDWSAAQHEELQLHAIATLSSVAPLLIEEYMSCQGNARVLAFLEWCESEDPFFSHGNSFHGTGGRGNKFAQMRYSLRLLRAVVYLEDETVNKDLCEKGTIQQMIGIFKNIISKPNEKEEAIVLEIQSDILLILSGLCENHIQRKEIFGTEGVDIVLHVMKTDPRKLQSGLGYNVLLFSTLDSIWCCILGCYPSEDYFLEKEGIFLLLDLLALNQKKFCNLILGIMVEFCDNPKTAAHVNAWQGKKDQTAASLLIKLWRKEEKELGVKRDKNGKIIDTKKPLFTSFQEEQKIIPLPANCPSIAVMDVSENIRAKIYAILGKLDFENLPGLSAEDFVTLCIIHRYLDFKIGEIWNEIYEEIKLEKLRPVTTDKKALEAITTASENIGKMVASLQSDIIESQACQDMQNEQKVYAKIQATHKQRELANKSWEDFLARTSNAKTLKKAKSLQEKAIEASRYHKRPQNAIFHQTHIKGLNTTVPSGGVVTVESTPARLVGGPLVDTDIALKKLPIRGGALQRVKAVKIVDAPKKSIPT

SEQ ID NO: 17300 - protein, 1121 aa, Homo sapiens
  Payload ID: 3482
  Gene Symbol: CFAP70
  Gene Name: cilia and flagella associated protein 70
  Uniprot ID: Q5T0N1
  ENSP ID: ENSP00000310829
MEQVPSAGRLVQITVTEGYDLKGFKGDTPVTFIRAEFNQVVLGDSAKITVSPEGSAKYNFTSSFEFNPEGGITSDDLAHKPVFLTVTEVLPKEKKQKEEKTLILGQAVVDLLPLLEGQSSFQTTVPLHPVQGSPLETPRSSAKQCSLEVKVLVAEPLLTTAQISGGNLLKVTLEAAYSVPESFIPTGPGQNYMVGLQVPSLGEKDYPILFKNGTLKLGGEREPVPRPKKWPIANILAPGANNIPDAFIVGGPYEEEEGELNHPEDSEFRNQAECIKKRIIWDLESRCYLDPSAVVSFQKRIADCRLWPVEITRVPLVTIPKGKAGKTEKTDEEAQLSFHGVAYVNMVPLLYPGVKRIRGAFHVYPYLDSVVHEKTKCLLSLFRDIGHHLIHNNKIGGINSLLSKQAVSKNLKEDKPVKEKDIDGRPRPGDVQAPSIKSQSSDTPLEGEPPLSHNPEGQQYVEAGTYIVLEIQLDKALVPKRMPEELARRVKEMIPPRPPLTRRTGGAQKAMSDYHIQIKNISRAILDEYYRMFGKQVAKLESDMDSETLEEQKCQLSYELNCSGKYFAFKEQLKHAVVKIVRDKYLKTTSFESQEELQTFISELYVFLVDQMHVALNQTMPDDVQGTVATIYTSSEQLQLFAFEAEVNENFEMAAAYYKERLVREPQNLDHWLDYGAFCLLTEDNIKAQECFQKALSLNQSHIHSLLLCGVLAVLLENYEQAEIFFEDATCLEPTNVVAWTLLGLYYEIQNNDIRMEMAFHEASKQLQARMLQAQVTKQKSTGVEDTEERGKRESSLGPWGITNGSATAIKVEAPAGPGAALSILDKFLEESSKLQSDSQEPILTTQTWDPSISQKPSNTFIKEIPTKKEASKCQDSSALLHPGLHYGVSQTTTIFMETIHFLMKVKAVQYVHRVLAHELLCPQGGPSCEYYLVLAQTHILKKNFAKAEEYLQQAAQMDYLNPNVWGLKGHLYFLSGNHSEAKACYERTISFVVDASEMHFIFLRLGLIYLEEKEYEKAKKTYMQACKRSPSCLTWLGLGIACYRLEELTEAEDALSEANALNNYNAEVWAYLALVCLKVGRQLEAEQAYKYMIKLKLKDEALLAEIHTLQETVGFGNPSF

SEQ ID NO: 17301 - protein, 361 aa, Homo sapiens
  Payload ID: 3482
  Gene Symbol: CFAP70
  Gene Name: cilia and flagella associated protein 70
  ENSP ID: ENSP00000343650
MEQVPSAGRLVQITVTEGYDLKGFKGDTPVTFIRAEFNQVVLGDSAKITVSPEGSAKYNFTSSFEFNPEGGITSDDLAHKPVFLTVTEVLPKEKKQKEEKTLILGQAVVDLLPLLEGQSSFQTTVPLHPVQGSPLETPRSSAKQCSLEVKVLVAEPLLTTAQISGGNLLKVTLEAAYSVPESFIPTGPGQNYMVGLQVPSLGEKDYPILFKNGTLNGNHSEAKACYERTISFVVDASEMHFIFLRLGLIYLEEKEYEKAKKTYMQACKRSPSCLTWLGLGIACYRLEELTEAEDALSEANALNNYNAEVWAYLALVCLKVGRQLEAEQAYKYMIKLKLKDEALLAEIHTLQETVGFGNPSF

SEQ ID NO: 17302 - protein, 590 aa, Homo sapiens
  Payload ID: 3482
  Gene Symbol: CFAP70
  Gene Name: cilia and flagella associated protein 70
  ENSP ID: ENSP00000347781
MFGKQVAKLESDMDSETLEEQKCQLSYELNCSGKYFAFKEQLKHAVVKIVRDKYLKTTSFESQEELQTFISELYVFLVDQMHVALNQTMPDDVQGTVATIYTSSEQLQLFAFEAEVNENFEMAAAYYKERLVREPQNLDHWLDYGAFCLLTEDNIKAQECFQKALSLNQSHIHSLLLCGVLAVLLENYEQAEIFFEDATCLEPTNVVAWTLLGLYYEIQNNDIRMEMAFHEASKQLQARMLQAQVTKQKSTGVEDTEERGKRESSLGPWGITNGSATAIKVEAPAGPGAALSILDKFLEESSKLQSDSQEPILTTQTWDPSISQKPSNTFIKEIPTKKEASKCQDSSALLHPGLHYGVSQTTTIFMETIHFLMKVKAVQYVHRVLAHELLCPQGGPSCEYYLVLAQTHILKKNFAKAEEYLQQAAQMDYLNPNVWGLKGHLYFLSGNHSEAKACYERTISFVVDASEMHFIFLRLGLIYLEEKEYEKAKKTYMQACKRSPSCLTWLGLGIACYRLEELTEAEDALSEANALNNYNAEVWAYLALVCLKVGRQLEAEQAYKYMIKLKLKDEALLAEIHTLQETVGFGNPSF

SEQ ID NO: 17303 - protein, 179 aa, Homo sapiens [sequence omitted]

SEQ ID NO: 17304 - protein, 498 aa, Homo sapiens
  Payload ID: 3482
  Gene Symbol: CFAP70
  Gene Name: cilia and flagella associated protein 70
  ENSP ID: ENSP00000409527
QEELQTFISELYVFLVDQMHVALNQTMPDDVQGTVATIYTSSEQLQLFAFEAEVNENFEMAAAYYKERLVREPQNLDHWLDYGAFCLLTEDNIKAQECFQKALSLNQSHIHSLLLCGVLAVLLENYEQAEIFFEDATCLEPTNVVAWTLLGLYYEIQNNDIRMEMAFHEASKQLQARMLQAQVTKQKSTGVEDTEERGKRESSLGPWGITNGSATAIKVEAPAGPGAALSILDKFLEESSKLQSDSQEPILTTQTWDPSISQKPSNTFIKEIPTKKEASKCQDSSALLHPGLHYGVSQTTTIFMETIHFLMKVKAVQYVHRVLAHELLCPQGGPSCEYYLVLAQTHILKKNFAKAEEYLQQAAQMDYLNPNVWGLKGHLYFLSGNHSEAKACYERTISFVVDASEMHFIFLRLGLIYLEEKELEELTEAEDALSEANALNNYNAEVWAYLALVCLKVGRQLEAEQAYKYMIKLKLKDEALLAEIHTLQETVGFGNPSF

SEQ ID NO: 17305 - protein, 308 aa, Homo sapiens
  Payload ID: 3483
  Gene Symbol: CFAP73
  Gene Name: cilia and flagella associated protein 73
  Uniprot ID: A6NFT4
  ENSP ID: ENSP00000333915
MAVPWEEYFRLALQEKLSTKLPEQAEDHVPPVLRLLEKRQELVDADQALQAQKEVFRTKTAALKQRWEQLEQKERELKGSFIRFDKFLQDSEARRNRALRRAAEERHQAGRREVEALRLWTQLQELRREHARLQRRLKRLEPCARLLEQALELLPGFQEVPELVARFDGLAETQAALRLREREQLAELEAARARLQQLRDAWPDEVLAQGQRRAQLQERLEAARERTLQWESKWIQIQNTAAEKTLLLGRSRMAVLNLFQLVCQHQGQPPTLDIEDTEGQLEHVKLFMQDLSAMLAGLGQAEPAAPAS

SEQ ID NO: 17306 - protein, 124 aa, Homo sapiens
  Payload ID: 3483
  Gene Symbol: CFAP73
  Gene Name: cilia and flagella associated protein 73
  ENSP ID: ENSP00000447276
  MOD_RES (1)..(1): Any amino acid
XALRRAAEERHQAGRREVEALRLWTQLQELRREHARLQRRLKRLEPCARLLEQALELLPGESKWIQIQNTAAEKTLLLGRSRMAVLNLFQLVCQHQGQPPTLDIEDTEGQLEHVKLFMQDLSAM

SEQ ID NO: 17307 - protein, 92 aa, Homo sapiens
  Payload ID: 3484
  Gene Symbol: CFAP74
  Gene Name: cilia and flagella associated protein 74
  ENSP ID: ENSP00000367853
EDELLADALLLEDERDELEDPEFDIKCLLQEAEDDVDPGHSSSVKELDTDADKLKKKTAEDRTQAFHLRQNLSALDKMHEEQELFTEKMSVS

SEQ ID NO: 17308 - protein, 1584 aa, Homo sapiens
  Payload ID: 3484
  Gene Symbol: CFAP74
  Gene Name: cilia and flagella associated protein 74
  Uniprot ID: Q9C0B2
  ENSP ID: ENSP00000417061
MEDDGSLLPEDELLADALLLEDERDELEDPEFDIKCLLQEAEDDVDPGHSSSVKELDTDADKLKKKTAEDRTQAFHLRQNLSALDKMHEEQELFTEKMRGELRACRQRRDLIDKQQEAVAAEIATEEEAGNMAAVGRLQAVSRRLFAELENERDLQSRTEAVLKESENTMWHIEIQEGRLEAFRTADREEVEATGRRLQVRAAEQLCREQEALGKVERNRLLRIRKSLNTQKELGLRHQKLLEDARKNHKVAVRFLKASLGRIREQEKKEEMECHEYMRRRMDAVVALKGSISANRDTLRKFQAWDRAKAELAEQRVQAEKKAILAQGRDAFRHLVHQRRRQELEAQKRAFEEEQKLRKQEIISRILKEEAEEEKRKKQHPPTSARHRLTLRDKTWNYISDFCKKTTVPTNTYTLDYEAAAGPGPSRLLEVVSSELIQGDPGASSEEETLAEPEISGLWNEDYKPYQVPKEDVDRKPVGGTKMDKDILERTVERLRSRVVHKQVVWGREFQGRPFNSKPELLHFQDFDIGKVYKKKITLVNTTYTINYCKLVGVEEHLRDFIHVDFDPPGPLSAGMSCEVLVTFKPMINKDLEGNISFLAQTGEFSVPLKCSTKKCSLSLDKELIDFGSYVVGETTSRTITLTNVGGLGTTFKFLPASEPCEMDDSQSALKLSSLLTYEDKSLYDKAATSFSEQQLEGTESSQADMQSRKELEKLDKEQEEEQPAEPERLTTVIPPSEEQTEITLGEVTEGEIGPFSSIKVPIVFTPVVPGDVQARFKVTFKNPQCPTLHFRVVGVAIDVPVWVPKPSVDLKICMYDRLYQDSVLVHTRSKAALRLKFEVCKELRAHLELLPKTGYIQAQSSYSVQLKFLPRHSLPEDAGRYFDKETRVLEAPMTIWVADQNKPVGFTVHAIVTTSDLELSPSEVDFGYCTIYEAIRTEISLHNHSLLPQEFGFVRLPKFVDVQPNDGFGTILPLETLQFCVIFQPTKAEEHRFQLTCKSEINRCFKLSCRAVGVHPPLELSHYQIKFAATALYDTSVATVYVINSHLSMSSPTHSKPRIGSEDASPMGPTSFEFLLPPDSPITISPSVGTVWPGKRCLVQVAFRPVLPEKLIRQEALPLLNKEMETKSFRKNMAPQRKDLHGLSFSVLRAQNRDKLFKVSVPHVLEMRKRELRPSSDEYQAARATLLRAFQAKFDTFVVPCVVASGDIKDRKGSEPLSFSPHNTLYLELWCPTVAPSVVVTSHKGKTIFNFGDVAVGHRSIKKISIQNVSPEDLALDFSLLNPNGPFVLLNHSSLLRAGGTQVLVLSFSPHESILAQETLDIITKRGTLTLTLMGTGVASMITCSIEGSVLNMGYVIAGESVSSGFKLQNNSLLPIKFSMHLDSLSSTRGRGQQQLPQFLSSPSQRTEVVGTQNLNGQSVFSVAPVKGVMDPGKTQDFTVTFSPDHESLYFSDKLQVVLFEKKISHQILLKGAACQHMMFVEGGDPLDVPVESLTAIPVFDPRHREEAEELRPILVTLDYIQFDTDTPAPPATRELQVGCIRTTQPSPKKPDHPLMVSALLQLRGDVKETYKVIFVAQVLTGP

SEQ ID NO: 17309 - protein, 320 aa, Homo sapiens
  Payload ID: 3485
  Gene Symbol: CFAP77
  Gene Name: cilia and flagella associated protein 77
  Uniprot ID: Q6ZQR2
  ENSP ID: ENSP00000343290
MPEARSSGPDLTRWRKQQQPVRRTVSQVCPPPRRPLTVADIRSGMENERLGVVRDSMFQNPLIVKAAGPASVGTSYSVYDSSAVQKVIPSLAGHHIKGGPQAELGKPRERSYSLPGINFNYGLYIRGLDGGVPEAIGRWNVFKQQPTCPHELTRNYIAMNRGAVKAGLVTARENLLYRQLNDIRISDQDDRRMKKEPPPLPPNMTFGIRARPSTPFFDLLQHRYLQLWVQEQKATQKAIKLEKKQKVVLGKLYETRSSQLRKYKPPVKLDTLWHMPHFQKVGRHLDTFPTEADRQRALKAHREECAVRQGTLRMGNYTHP

SEQ ID NO: 17310 - protein, 198 aa, Homo sapiens
  Payload ID: 3485
  Gene Symbol: CFAP77
  Gene Name: cilia and flagella associated protein 77
  ENSP ID: ENSP00000376908
MPEARSSGPDLTRWRKQQQPVRRTVSQVCPPPRRPLTVADIRSGMENERLGVVRDSMFQNPLIVKAELGKPRERSYSLPGINFNYGLYIRGLDGGVPEAIGRWNVFKQQPTCPHELTRNYIAMNRGAVKAGLVTARENLLYRQLNDIRISDQDDRRMKKEPPPLPPNMTFGIRARKLSKQIEKFRSNITNSREPTTWI

SEQ ID NO: 17311 - protein, 284 aa, Homo sapiens
  Payload ID: 3485
  Gene Symbol: CFAP77
  Gene Name: cilia and flagella associated protein 77
  Uniprot ID: Q6ZQR2
  ENSP ID: ENSP00000376909
MPEARSSGPDLTRWRKQQQPVRRTVSQVCPPPRRPLTVADIRSGMENERLGVVRDSMFQNPLIVKAELGKPRERSYSLPGINFNYGLYIRGLDGGVPEAIGRWNVFKQQPTCPHELTRNYIAMNRGAVKAGLVTARENLLYRQLNDIRISDQDDRRMKKEPPPLPPNMTFGIRARPSTPFFDLLQHRYLQLWVQEQKATQKAIKLEKKQKVVLGKLYETRSSQLRKYKPPVKLDTLWHMPHFQKVGRHLDTFPTEADRQRALKAHREECAVRQGTLRMGNYTHP

SEQ ID NO: 17312 - protein, 64 aa, Homo sapiens
  Payload ID: 3486
  Gene Symbol: CFAP97
  Gene Name: cilia and flagella associated protein 97
  ENSP ID: ENSP00000296775
MDQFGDILEGEVDHSFFDSDFEEGKKCETNSVFDKQNDDPKERIDKDTKCKFEHWNANNRKLSY

SEQ ID NO: 17313 - protein, 532 aa, Homo sapiens
  Payload ID: 3486
  Gene Symbol: CFAP97
  Gene Name: cilia and flagella associated protein 97
  Uniprot ID: Q9P2B7
  ENSP ID: ENSP00000409964
MDQFGDILEGEVDHSFFDSDFEEGKKCETNSVFDKQNDDPKERIDKDTKNVNSNTGMQTTENYLTEKGNERNVKFPPEHPVENDVTQTVSSFSLPASSRSKKLCDVTTGLKIHVSIPNRIPKIVKEGEDDYYTDGEESSDDGKKYHVKSKSAKPSTNVKKSIRKKYCKVSSSSSSSLSSSSSGSGTDCLDAGSDSHLSDSSPSSKSSKKHVSGITLLSPKHKYKSGIKSTETQPSSTTPKCGHYPEESEDTVTDVSPLSTPDISPLQSFELGIANDQKVKIKKQENVSQEIYEDVEDLKNNSKYLKAAKKGKEKHEPDVSSKSSSVLDSSLDHRHKQKVLHDTMDLNHLLKAFLQLDKKGPQKHHFDQPSVAPGKNYSFTREEVRQIDRENQRLLKELSRQAEKPGSKSTIPRSADHPPKLYHSALNRQKEQQRIERENLALLKRLEAVKPTVGMKRSEQLMDYHRNMGYLNSSPLSRRARSTLGQYSPLRASRTSSATSGLSCRSERSAVDPSSGHPRRRPKPPNVRTAWL

SEQ ID NO: 17314 - protein, 143 aa, Homo sapiens
  Payload ID: 3486
  Gene Symbol: CFAP97
  Gene Name: cilia and flagella associated protein 97
  ENSP ID: ENSP00000420832
MDQFGDILEGEVDHSFFDSDFEEGKKCETNSVFDKQNDDPKERIDKDTKNVNSNTGMQTTENYLTEKGNERNVKFPPEHPVENDVTQTVSSFSLPASSRSKKLCDVTTGLKIHVSIPNRIPKIVKEGEDDYYTDGEESSDDGK

SEQ ID NO: 17315 - protein, 453 aa, Homo sapiens
  Payload ID: 3486
  Gene Symbol: CFAP97
  Gene Name: cilia and flagella associated protein 97
  Uniprot ID: Q9P2B7
  ENSP ID: ENSP00000423312
MDQFGDILEGEVDHSFFDSDFEEGKKCETNSVFDKQNDDPKERIDKDTKNVNSNTGMQTTENYLTEKGNERNVKFPPEHPVENDVTQTVSSFSLPASSRSKKLCDVTTGLKIHVSIPNRIPKIVKEGEDDYYTDGEESSDDGKKYHVKSKSAKPSTNVKKSIRKKYCKVSSSSSSSLSSSSSGSGTDCLDAGSDSHLSDSSPSSKSSKKHVSGITLLSPKHKYKSGIKSTETQPSSTTPKCGHYPEESEDTVTDVSPLSTPDISPLQSFELGIANDQKVKIKKQENVSQEIYEDVEDLKNNSKYLKAAKKGKEKHEPDVSSKSSSVLDSSLDHRHKQKVLHDTMDLNHLLKAFLQLDKKGPQKHHFDQPSVAPGKNYSFTREEVRQIDRENQRLLKELSRQAEKPGSKSTIPRSADHPPKLYHSALNRQKEQQRIERENLTISLCHPGWSAVT

SEQ ID NO: 17316 - protein, 646 aa, Homo sapiens
  Payload ID: 3487
  Gene Symbol: CFAP99
  Gene Name: cilia and flagella associated protein 99
  ENSP ID: ENSP00000480601
MAYYGKCIETVIEQLDKFTPKRDNPEQFLEAAATSLQALSPQKQSFVLEVLSGCLEYRKLLTVVVDAFYVEDGRLCLRVDHSRFEVICYLATFLLEELGFQLFCNIIKSQPVDKMCKFLRFFFNPLHLCSWIKDEWSLIYEPAHVKENWIDPLMRWQPEVQELINHLEGVSASQSSPLKTKAKVTEPKEFNLTAPRPRTIPAPEPVPVVAKPRPVPQSTYQPPKEQQQLETVKRYNRRKAEELLLRANIEELRCAMPRSCRERVQGSKQQLRLQFPPRIRKTPKLTFYRPDNILVKLNTTAILREGALYQRQVEQELQRVDKLVDGAGDFSEFFEWQKKMQAKDREEQLAASECRRLQGKLSHEEAVLARQSLMQENKQRVEQQKEQMAKLMLQRAERRLREDRSRKELVEQVIEGQKNAKAAQTKLAKGRQQTVQEAIEESRGLLQRRAQAAQEEQRRRCELISQLRALETQPTRKGKLVDLTQIPGYGLEGEMSIVELRERLALLKENQRRKEEEKRDQIIQGKHTKSQELQNMVEQISLCRAAMGRSAALRWEEKKALAAAPAAPSQDERVQQLRRRISERAAERSRQAALLHVSAPRTARPKPRAQLEAQHWLELERSRERRLQALQQGGSGPGPARRLEAA

SEQ ID NO: 17317 - protein, 459 aa, Homo sapiens
  Payload ID: 3488
  Gene Symbol:
  Gene Name: Cilia- and flagella-associated protein 99 [Source:UniProtKB/Swiss-Prot Acc:D6REC4]
  Uniprot ID: D6REC4
  ENSP ID: ENSP00000425050
MPRSCRERVQGSKQQLRLQFPPRIRKTPKLTFYRPDNILVKLNTTAILREGALYQRQVEQELQRVDKLVDGAGDFSEFFEWQKKMQAKDREEQLAASECRRLQGKLSHEEAVLARQSLMQENKQRVEQQKEQMAKLMLQRAERRLREDRSRKELVEQVIEGQKNAKAAQTKLAKGRQQTVQEAIEESRGLLQRRAQAAQEEQRRRCELISQLRALETQPTRKGKLVDLTQIPGYGLEGEMSIVELRERLALLKENQRRKEEEKRDQIIQGKHTKSQELQNMVEQISLCRAAMGRSAALRWEEKKALAAAPAAPSQDERVQQLRRRISERAAERSRQAALLHVSAPRTARPKPRVSPDWWEEPGRLKAGAGWGWRARRAGTGVPGRGWRGDRVRSAAGRYAAAGAGGGGGVPARADAFPGLQAQLEAQHWLELERSRERRLQALQQGGSGPGPARRLEAA

SEQ ID NO: 17318 - protein, 714 aa, Homo sapiens
  Payload ID: 3488
  Gene Symbol:
  Gene Name: Cilia- and flagella-associated protein 99 [Source:UniProtKB/Swiss-Prot Acc:D6REC4]
  ENSP ID: ENSP00000488922
MAYYGKCIETVIEQLDKFTPKRDNPEQFLEAAATSLQALSPQKQSFVLEVLSGCLEYRKLLTVVVDAFYVEDGRLCLRVDHSRFEVICYLATFLLEELGFQLFCNIIKSQPVDKMCKFLRFFFNPLHLCSWIKDEWSLIYEPAHVKENWIDPLMRWQPEVQELINHLEGVSASQSSPLKTKAKVTEPKEFNLTAPRPRTIPAPEPVPVVAKPRPVPQSTYQPPKEQQQLETVKRYNRRKAEELLLRANIEELRCAMPRSCRERVQGSKQQLRLQFPPRIRKTPKLTFYRPDNILVKLNTTAILREGALYQRQVEQELQRVDKLVDGAGDFSEFFEWQKKMQAKDREEQLAASECRRLQGKLSHEEAVLARQSLMQENKQRVEQQKEQMAKLMLQRAERRLREDRSRKELVEQVIEGQKNAKAAQTKLAKGRQQTVQEAIEESRGLLQRRAQAAQEEQRRRCELISQLRALETQPTRKGKLVDLTQIPGYGLEGEMSIVELRERLALLKENQRRKEEEKRDQIIQGKHTKSQELQNMVEQISLCRAAMGRSAALRWEEKKALAAAPAAPSQDERVQQLRRRISERAAERSRQAALLHVSAPRTARPKPRVSPDWWEEPGRLKAGAGWGWRARRAGTGVPGRGWRGDRVRSAAGRYAAAGAGGGGGVPARADAFPGLQAQLEAQHWLELERSRERRLQALQQGGSGPGPARRLEAA

SEQ ID NO: 17319 - protein, 200 aa, Homo sapiens
  Payload ID: 3489
  Gene Symbol: CNTF
  Gene Name: ciliary neurotrophic factor
  Uniprot ID: P26441
  ENSP ID: ENSP00000355370
MAFTEHSPLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 17320 - protein, 372 aa, Homo sapiens
  Payload ID: 3490
  Gene Symbol: CNTFR
  Gene Name: ciliary neurotrophic factor receptor
  Uniprot ID: P26992
  ENSP ID: ENSP00000242338
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQHVELSDGTAHTITDAYAGKEYIIQVAAKDNEIGTWSDWSVAAHATPWTEEPRHLTTEAQAAETTTSTTSSLAPPPTTKICDPGELGSGGGPSAPFLVSVPITLALAAAAATASSLLI

SEQ ID NO: 17321 - protein, 372 aa, Homo sapiens; identical to SEQ ID NO: 17320
  Payload ID: 3490
  Gene Symbol: CNTFR
  Gene Name: ciliary neurotrophic factor receptor
  Uniprot ID: P26992
  ENSP ID: ENSP00000368265

SEQ ID NO: 17322 - protein, 256 aa, Homo sapiens
  Payload ID: 3490
  Gene Symbol: CNTFR
  Gene Name: ciliary neurotrophic factor receptor
  ENSP ID: ENSP00000388082
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQH

SEQ ID NO: 17323 - protein, 372 aa, Homo sapiens; identical to SEQ ID NO: 17320
  Payload ID: 3490
  Gene Symbol: CNTFR
  Gene Name: ciliary neurotrophic factor receptor
  Uniprot ID: P26992
  ENSP ID: ENSP00000480451

SEQ ID NO: 17324 - protein, 2017 aa, Homo sapiens
  Payload ID: 3491
  Gene Symbol: CROCC
  Gene Name: ciliary rootlet coiled-coil, rootletin
  Uniprot ID: Q5TZA2
  ENSP ID: ENSP00000364691
MSLGLAGAQEVELTLETVIQTLESSVLCQEKGLGARDLAQDAQITSLPALIREIVTRNLSQPESPVLLPATEMASLLSLQEENQLLQQELSRVEDLLAQSRAERDELAIKYNAVSERLEQALRLEPGELETQEPRGLVRQSVELRRQLQEEQASYRRKLQAYQEGQQRQAQLVQRLQGKILQYKKRCSELEQQLLERSGELEQQRLRDTEHSQDLESALIRLEEEQQRSASLAQVNAMLREQLDQAGSANQALSEDIRKVTNDWTRCRKELEHREAAWRREEESFNAYFSNEHSRLLLLWRQVVGFRRLVSEVKMFTERDLLQLGGELARTSRAVQEAGLGLSTGLRLAESRAEAALEKQALLQAQLEEQLRDKVLREKDLAQQQMQSDLDKADLSARVTELGLAVKRLEKQNLEKDQVNKDLTEKLEALESLRLQEQAALETEDGEGLQQTLRDLAQAVLSDSESGVQLSGSERTADASNGSLRGLSGQRTPSPPRRSSPGRGRSPRRGPSPACSDSSTLALIHSALHKRQLQVQDMRGRYEASQDLLGTLRKQLSDSESERRALEEQLQRLRDKTDGAMQAHEDAQREVQRLRSANELLSREKSNLAHSLQVAQQQAEELRQEREKLQAAQEELRRQRDRLEEEQEDAVQDGARVRRELERSHRQLEQLEGKRSVLAKELVEVREALSRATLQRDMLQAEKAEVAEALTKAEAGRVELELSMTKLRAEEASLQDSLSKLSALNESLAQDKLDLNRLVAQLEEEKSALQGRQRQAEQEATVAREEQERLEELRLEQEVARQGLEGSLRVAEQAQEALEQQLPTLRHERSQLQEQLAQLSRQLSGREQELEQARREAQRQVEALERAAREKEALAKEHAGLAVQLVAAEREGRTLSEEATRLRLEKEALEGSLFEVQRQLAQLEARREQLEAEGQALLLAKETLTGELAGLRQQIIATQEKASLDKELMAQKLVQAEREAQASLREQRAAHEEDLQRLQREKEAAWRELEAERAQLQSQLQREQEELLARLEAEKEELSEEIAALQQERDEGLLLAESEKQQALSLKESEKTALSEKLMGTRHSLATISLEMERQKRDAQSRQEQDRSTVNALTSELRDLRAQREEAAAAHAQEVRRLQEQARDLGKQRDSCLREAEELRTQLRLLEDARDGLRRELLEAQRKLRESQEGREVQRQEAGELRRSLGEGAKEREALRRSNEELRSAVKKAESERISLKLANEDKEQKLALLEEARTAVGKEAGELRTGLQEVERSRLEARRELQELRRQMKMLDSENTRLGRELAELQGRLALGERAEKESRRETLGLRQRLLKGEASLEVMRQELQVAQRKLQEQEGEFRTRERRLLGSLEEARGTEKQQLDHARGLELKLEAARAEAAELGLRLSAAEGRAQGLEAELARVEVQRRAAEAQLGGLRSALRRGLGLGRAPSPAPRPVPGSPARDAPAEGSGEGLNSPSTLECSPGSQPPSPGPATSPASPDLDPEAVRGALREFLQELRSAQRERDELRTQTSALNRQLAEMEAERDSATSRARQLQKAVAESEEARRSVDGRLSGVQAELALQEESVRRSERERRATLDQVATLERSLQATESELRASQEKISKMKANETKLEGDKRRLKEVLDASESRTVKLELQRRSLEGELQRSRLGLSDREAQAQALQDRVDSLQRQVADSEVKAGTLQLTVERLNGALAKVEESEGALRDKVRGLTEALAQSSASLNSTRDKNLHLQKALTACEHDRQVLQERLDAARQALSEARKQSSSLGEQVQTLRGEVADLELQRVEAEGQLQQLREVLRQRQEGEAAALNTVQKLQDERRLLQERLGSLQRALAQLEAEKREVERSALRLEKDRVALRRTLDKVEREKLRSHEDTVRLSAEKGRLDRTLTGAELELAEAQRQIQQLEAQVVVLEQSHSPAQLEVDAQQQQLELQQEVERLRSAQAQTERTLEARERAHRQRVRGLEEQVSTLKGQLQQELRRSSAPFSPPSGPPEK

SEQ ID NO: 17325 - protein, 1311 aa, Homo sapiens
  Payload ID: 3491
  Gene Symbol: CROCC
  Gene Name: ciliary rootlet coiled-coil, rootletin
  ENSP ID: ENSP00000402626
  MOD_RES (1)..(1): Any amino acid
XREIVTRNLSQPESPVLLPATEMASLLSLQEENQLLQQELSRVEDLLAQSRAERDELAIKYNAVSERDTEHSQDLESALIRLEEEQQRSASLAQVNAMLREQLDQAGSANQALSEDIRKVTNDWTRCRKELEHREAAWRREEESFNAYFSNEHSRLLLLWRQVVGFRRLVSEVKMFTERDLLQLGGELARTSRAVQEAGLGLSTGLRLAESRAEAALEKQALLQAQLEEQLRDKVLREKDLAQQQMQSDLDKADLSARVTELGLAVKRLEKQNLEKDQVNKDLTEKLEALESLRLQEQAALETEDGEGLQQTLRDLAQAVLSDSESGVQLSGSERTADASNGSLRGLSGQRTPSPPRRSSPGRGRSPRRGPSPACSDSSTLALIHSALHKRQLQVQDMRGRYEASQDLLGTLRKQLSDSESERRALEEQLQRLRDKTDGAMQAHEDAQREVQRLRSANELLSREKSNLAHSLQVAQQQAEELRQEREKLQAAQEELRRQRDRLEEEQEDAVQDGARVRRELERSHRQLEQLEGKRSVLAKELVEVREALSRATLQRDMLQAEKAEVAEALTKAEAGRVELELSMTKLRAEEASLQDSLSKLSALNESLAQDKLDLNRLVAQLEEEKSALQGRQRQAEQEATVAREEQERLEELRLEQEVARQGLEGSLRVAEQAQEALEQQLPTLRHERSQLQEQLAQLSRQLSGREQELEQARREAQRQVEALERAAREKEALAKEHAGLAVQLVAAEREGRTLSEEATRLRLEKEALEGSLFEVQRQLAQLEARREQLEAEGQALLLAKETLTGELAGLRQQIIATQEKASLDKELMAQKLVQAEREAQASLREQRAAHEEDLQRLQREKEAAWRELEAERAQLQSQLQREQEELLARLEAEKEELSEEIAALQQERDEGLLLAESEKQQALSLKESEKTALSEKLMGTRHSLATISLEMERQKRDAQSRQEQDRSTVNALTSELRDLRAQREEAAAAHAQEVRRLQEQARDLGKQRDSCLREAEELRTQLRLLEDARDGLRRELLEAQRKLRESQEGREVQRQEAGELRRSLGEGAKEREALRRSNEELRSAVKKAESERISLKLANEDKEQKLALLEEARTAVGKEAGELRTGLQEVERSRLEARRELQELRRQMKMLDSENTRLGRELAELQGRLALGERAEKESRRETLGLRQRLLKGEASLEVMRQELQVAQRKLQEQEGEFRTRERRLLGSLEEARGTEKQQLDHARGLELKLEAARAEAAELGLRLSAAEGRAQGLEAELARVEVQRRAAEAQLGGLRSALRRGLGLGRAPS

SEQ ID NO: 17326 - protein, 204 aa, Homo sapiens
  Payload ID: 3491
  Gene Symbol: CROCC
  Gene Name: ciliary rootlet coiled-coil, rootletin
  ENSP ID: ENSP00000478281
LRDKVLREKDLAQQQMQSDLDKADLSARVTELGLAVKRLEKQNLEKDQVNKDLTEKLEALAVLSDSESGVQLSGSERTADASNGSLRGLSGQRTPSPPRRSSPGRGRSPRRGPSPACSDSSTLALIHSALHKRQLQVQDMRGRYEASQDLLGTLRKQLSDSESERRALEEQLQRLRDKTDGAMQAHEDAQREVQRLRSANELLS

SEQ ID NO: 17327 - protein, 838 aa, Homo sapiens
  Payload ID: 3491
  Gene Symbol: CROCC
  Gene Name: ciliary rootlet coiled-coil, rootletin
  ENSP ID: ENSP00000480016
  MOD_RES (1)..(1): Any amino acid
XPATSPSLRAQLEQALRLEPGELETQEPRGLVRQSVELRRQLQEEQASYRRKLQAYQEGQQRQAQLVQRLQGKILQYKKRCSELEQQLLERSGELEQQRLRDTEHSQDLESALIRLEEEQQRSASLAQVNAMLREQLDQAGSANQALSEDIRKVTNDWTRCRKELEHREAAWRREEESFNAYFSNEHSRLLLLWRQVVGFRRLVSEVKMFTERDLLQLGGELARTSRAVQEAGLGLSTGLRLAESRAEAALEKQALLQAQLEEQLRDKVLREKDLAQQQMQSDLDKADLSARVTELGLAVKRLEKQNLEKDQVNKDLTEKLEALESLRLQEQAALETEDGEGLQQTLRDLAQAVLSDSESGVQLSGSERTADASNGSLRGLSGQRTPSPPRRSSPGRGRSPRRGPSPACSDSSTLALIHSALHKRQLQVQDMRGRYEASQDLLGTLRKQLSDSESERRALEEQLQRLRDKTDGAMQAHEDAQREVQRLRSANELLSREKSNLAHSLQVAQQQAEELRQEREKLQAAQEELRRQRDRLEEEQEDAVQDGARVRRELERSHRQLEQLEGKRSVLAKELVEVREALSRATLQRDMLQAEKAEVAEALTKAEAGRVELELSMTKLRAEEASLQDSLSKLSALNESLAQDKLDLNRLVAQLEEEKSALQGRQRQAEQEATVAREEQERLEELRLEQEVARQGLEGSLRVAEQAQEALEQQLPTLRHERSQLQEQLAQEAAWRELEAERAQLQSQLQREQEELLARLEAEKEELSEEIAALQQERDEGLLLAESEKQQALSLKESEKTALSEKLMGTRHSLATISLEMERQKRDAQSRQEQDRV

SEQ ID NO: 17328 - protein, 1655 aa, Homo sapiens
  Payload ID: 3492
  Gene Symbol: CROCC2
  Gene Name: ciliary rootlet coiled-coil, rootletin family member 2
  Uniprot ID: H7BZ55
  ENSP ID: ENSP00000397968
MSSASSEPGNGDASQQPLLGLDTVIQRLEDTILSPTASREDRALTVRGEGRQASPTPVPTRIREIVAGSLSEEPPQAGVQEPTATVARVQEENELLQEELTRLGDLLAQASAERDELASRCRVVSEQLQARLETTEAQLRRSELEHSVDLEEALGRLEAAEERSTGLCQVNALLREQLEHMKKANDALGRELAGMTGSVQRLQGELELRRWAQRQTRSGGLGQPRDLLLLWRQAVVLGTDLAELRVATERGLADLQADTARTARRLHTACLNLDSNLRLSASSTASTLGQQLRDKAGEMLQLQGRWDAEKVALQARLSEQTLLVEKLTEQNEQKAKTIAALRTDLQNLVAQEDARCLELAGSSITELGEPRRPLRSPQRATSPHQGASPPHICSPATLDPALQAMRAAIERRWRREQELCLQLKSSQALVASLQEQLSESRRELWAAQKLQQERAREQAREREALRGQLEAQRLEVQQCRASCKLLGREKAALEMVVEELKGKADAADAEKQGLEAEAAELQRSLLLQAERREELALRRERSCRALETSQGRLQQLEEKVSGLREELASVREALSTAQLQRDVVESEREGLRSALARAECSNADLELLVRRLKSEGVEQRDSLAAMAALMEGLAQDKSALNHLALQLEQERDQLREQRKTLEQERARAGEQLAQAEQQLALERAERRGLQQACGRLEQRQEQLEGQAALLGREKAQLQEQVGQVTCQKQALEEQLAQSLQDQEAQMGTLQQALQGKDALSEERAQLLAKQEALERQGRLAAEEAADLRVERDSLESSLLEAQQLATKLQEQLEEEARSAGLARQALQVEMEQLQSDWEVQEMKLRQDTVRLQRQVAQQEREAQRALESQALAHREALAQLQREKETLSLTLAEEKEVARCQLEQEKELVTKSAAEREALKGEIQSLKQERDESLLQLEHKMQQVMALSLKETERSLLSEELSRARRTLERVQQEAQSQQEQAQATISATTEELKALQAQFEDAITAHQRETTALRESLQDLAAERGDVEREAERLRAQLTVAQEGLAALRQELQGVEESREGLHREAQEARRALSDEAREKDVLLLFNSELRATICRAEQEKASFKRSKEEKEQKLLILEEAQAALQQEASALRAHLWELEQAGGDARQELRELHRQVRTLKAENQRRSGEAHELQAQCSQEVLELRRQAAKAEAKHEGARKEVLGLQRKLAEVEAAGEAHGQRLQEHLRESRGAEQTLRAELHSVTRKLQEASGVADALQARLDQACHRIHSLEQELAQAEGARQDAEAQLGRLCSTLRRGLGLQRQSPWASPEQPGSPTKGSDSSQALPGQQGTSPPARPHSPLRWPSPTPGGRSSELMDVATVQDILRDFVQKLREAQRERDDSRIQMATLSSRLSEAECRCARAQSRVGQLQKALAEAEEGQRRVEGALSSARAARALQKEALRRLELEHLASVRAAGQEKRRLQEQLETLRQALEESRRHSQGLAKQGKLLEEQLTNLEHRCQKAEVSLEPLRQMEQETLKREEDVARLGAEKEQLDQSLNSLHQEVDGALRQNQQLQAQMTEMEQAHTQRLQDLTAQHQRDLATEAERLHGARPQATQALESQEWTHQQQVKVLEEQVASLKEQLDQEVQWRQQAHLGQAFQTGHAQRD

SEQ ID NO: 17329 - protein, 387 aa, Homo sapiens
  Payload ID: 3493
  Gene Symbol: CATIP
  Gene Name: ciliogenesis associated TTC17 interacting protein
  Uniprot ID: Q7Z7H3
  ENSP ID: ENSP00000289388
MSSKVYSTGSRAKDHQPSGPECLPLPEANAEAIDFLSSLHKEELQMLFFSETLAMVSDTGEPQGELTIEVQRGKYQEKLGMLTYCLFVHASSRGFLDKMLCGNSLLGYLSEKLELMEQHSQDFIKFLILPMERKMSLLKQDDQLAVTRSIKEGEEVKTGVTSFPWSSIKGFISEAANLVLLRVMAWRRMVPSNARFLTLDTEGKLCYLTYQNLGFQTIQVDHQQAEVFIVEQTVHAEEGIPMSCQYYLLSDGHLAKRIQVGSPGCCIITKMPILREEDEIEPRPVFEKKPLVWEEDMELYSKFLDRKEELRLGHASYLRQHPEAHALISDFLLFLLLRQPEDVVTFAAEFFGPFDPWRPSSPALGSSHRPNPFRSLEPEGDARSGAA

SEQ ID NO: 17330 - protein, 1203 aa, Homo sapiens
  Payload ID: 3494
  Gene Symbol: CGN
  Gene Name: cingulin
  Uniprot ID: Q9P2M7
  ENSP ID: ENSP00000271636
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTIDTAPLSSVDSLINKFDSQLGGQARGRTGRRTRMLPPEQRKRSKSLDSRLPRDTFEERERQSTNHWTSSTKYDNHVGTSKQPAQSQNLSPLSGFSRSRQTQDWVLQSFEEPRRSAQDPTMLQFKSTPDLLRDQQEAAPPGSVDHMKATIYGILREGSSESETSVRRKVSLVLEKMQPLVMVSSGSTKAVAGQGELTRKVEELQRKLDEEVKKRQKLEPSQVGLERQLEEKTEECSRLQELLERRKGEAQQSNKELQNMKRLLDQGEDLRHGLETQVMELQNKLKHVQGPEPAKEVLLKDLLETRELLEEVLEGKQRVEEQLRLRERELTALKGALKEEVASRDQEVEHVRQQYQRDTEQLRRSMQDATQDHAVLEAERQKMSALVRGLQRELEETSEETGHWQSMFQKNKEDLRATKQELLQLRMEKEEMEEELGEKIEVLQRELEQARASAGDTRQVEVLKKELLRTQEELKELQAERQSQEVAGRHRDRELEKQLAVLRVEADRGRELEEQNLQLQKTLQQLRQDCEEASKAKMVAEAEATVLGQRRAAVETTLRETQEENDEFRRRILGLEQQLKETRGLVDGGEAVEARLRDKLQRLEAEKQQLEEALNASQEEEGSLAAAKRALEARLEEAQRGLARLGQEQQTLNRALEEEGKQREVLRRGKAELEEQKRLLDRTVDRLNKELEKIGEDSKQALQQLQAQLEDYKEKARREVADAQRQAKDWASEAEKTSGGLSRLQDEIQRLRQALQASQAERDTARLDKELLAQRLQGLEQEAENKKRSQDDRARQLKGLEEKVSRLETELDEEKNTVELLTDRVNRGRDQVDQLRTELMQERSARQDLECDKISLERQNKDLKTRLASSEGFQKPSASLSQLESQNQLLQERLQAEEREKTVLQSTNRKLERKVKELSIQIEDERQHVNDQKDQLSLRVKALKRQVDEAEEEIERLDGLRKKAQREVEEQHEVNEQLQARIKSLEKDSWRKASRSAAESALKNEGLSSDEEFDSVYDPSSIASLLTESNLQTSSC

SEQ ID NO: 17331 - protein, 131 aa, Homo sapiens
  Payload ID: 3494
  Gene Symbol: CGN
  Gene Name: cingulin
  ENSP ID: ENSP00000390686
  MOD_RES (1)..(1): Any amino acid
XQDPTMLQFKSTPDLLRDQQEAAPPGSVDHMKATIYGILREGSSESETSVRRKVSLVLEKMQPLVAVAGQGELTRKVEELQRKLDEEVKKRQKLEPSQVGLERQLEEKTEECSRLQELLERRKGEAQQSNK

SEQ ID NO: 17332 - protein, 291 aa, Homo sapiens
  Payload ID: 3494
  Gene Symbol: CGN
  Gene Name: cingulin
  ENSP ID: ENSP00000410836
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTIDTAPLSSVDSLINKFDSQLGGQARGRTGRRTRMLPPEQRKRSKSLDSRLPRDTFEERERQSTNHWTSSTKYDNHVGTSKQPAQSQNLSPLSGFSRSRQTQDWVLQSFEEPRRSAQDPTMLQ

SEQ ID NO: 17333 - protein, 170 aa, Homo sapiens
  Payload ID: 3494
  Gene Symbol: CGN
  Gene Name: cingulin
  ENSP ID: ENSP00000422299
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTI

SEQ ID NO: 17334 - protein, 170 aa, Homo sapiens; identical to SEQ ID NO: 17333
  Payload ID: 3494
  Gene Symbol: CGN
  Gene Name: cingulin
  ENSP ID: ENSP00000425532

SEQ ID NO: 17335 - protein, 1302 aa, Homo sapiens
  Payload ID: 3495
  Gene Symbol: CGNL1
  Gene Name: cingulin-like 1
  Uniprot ID: Q0VF96
  ENSP ID: ENSP00000281282
MELYFGEYQHVQQEYGVHLRLASDDTQKSRSSQNSKAGSYGVSIRVQGIDGHPYIVLNNTERCLAGTSFSENGPPFPPPVINNLPLHSSNGSVPKENSEELQLPENPYAQPSPIRNLKQPLLHEGKNGVLDRKDGSVKPSHLLNFQRHPELLQPYDPEKNELNLQNHQPSESNWLKTLTEEGINNKKPWTCFPKPSNSQPTSPSLEDPAKSGVTAIRLCSSVVIEDPKKQTSVCVNVQSCTKERVGEEALFTSGRPLTAHSPHAHPETKKTRPDVLPFRRQDSAGPVLDGARSRRSSSSSTTPTSANSLYRFLLDDQECAIHADNVNRHENRRYIPFLPGTGRDIDTGSIPGVDQLIEKFDQKPGLQRRGRSGKRNRINTDDRKRSRSVDSAFPFGLQGNSEYLIEFSRNLGKSSEHLLRPSQVCPQRPLSQERRGKQSVGRTFAKLQGAAHGASCAHSRPPQPNIDGKVLETEGSQESTVIRAPSLGAQSKKEEEVKTATATLMLQNRATATSPDSGAKKISVKTFPSASNTQATPDLLKGQQELTQQTNEETAKQILYNYLKEGSTDNDDATKRKVNLVFEKIQTLKSRAAGSAQGNNQACNSTSEVKDLLEQKSKLTIEVAELQRQLQLEVKNQQNIKEERERMRANLEELRSQHNEKVEENSTLQQRLEESEGELRKNLEELFQVKMEREQHQTEIRDLQDQLSEMHDELDSAKRSEDREKGALIEELLQAKQDLQDLLIAKEEQEDLLRKRERELTALKGALKEEVSSHDQEMDKLKEQYDAELQALRESVEEATKNVEVLASRSNTSEQDQAGTEMRVKLLQEENEKLQGRSEELERRVAQLQRQIEDLKGDEAKAKETLKKYEGEIRQLEEALVHARKEEKEAVSARRALENELEAAQGNLSQTTQEQKQLSEKLKEESEQKEQLRRLKNEMENERWHLGKTIEKLQKEMADIVEASRTSTLELQNQLDEYKEKNRRELAEMQRQLKEKTLEAEKSRLTAMKMQDEMRLMEEELRDYQRAQDEALTKRQLLEQTLKDLEYELEAKSHLKDDRSRLVKQMEDKVSQLEMELEEERNNSDLLSERISRSREQMEQLRNELLQERAARQDLECDKISLERQNKDLKSRIIHLEGSYRSSKEGLVVQMEARIAELEDRLESEERDRANLQLSNRRLERKVKELVMQVDDEHLSLTDQKDQLSLRLKAMKRQVEEAEEEIDRLESSKKKLQRELEEQMDMNEHLQGQLNSMKKDLRLKKLPSKVLDDMDDDDDLSTDGGSLYEAPVSYTFSKDSTVASQI

SEQ ID NO: 17336 - protein, 385 aa, Homo sapiens
  Payload ID: 3496
  Gene Symbol: CIART
  Gene Name: circadian associated repressor of transcription
  Uniprot ID: Q8N365
  ENSP ID: ENSP00000290363
MDSPSSVSSYSSYSLSSSFPTSPVNSDFGFPSDSEREDKGAHGPRPDTVGQRGGSRPSPGPIRCRHRSKVSGNQHTPSHPKQRGSASPMAGSGAKRSRDGELETSLNTQGCTTEGDLLFAQKCKELQGFIPPLTDLLNGLKMGRFERGLSSFQQSVAMDRIQRIVGVLQKPQMGERYLGTLLQVEGMLKTWFPQIAAQKSSLGGGKHQLTKHFPSHHSDSAASSPASPMEKMDQTQLGHLALKPKQPWHLTQWPAMNLTWIHTTPICNPPLSSPGTISFSHGPLGTGTGIGVILFLQHGVQPFTHSAPTTPVPPTTASPVIPGEPMKLSGEGPRCYSLPVTLPSDWSYTLSPPSLPTLARKMTIGHREQQRSHPPVAADAHLLNL

SEQ ID NO: 17337 - protein, 297 aa, Homo sapiens
  Payload ID: 3496
  Gene Symbol: CIART
  Gene Name: circadian associated repressor of transcription
  ENSP ID: ENSP00000358090
MAGSGAKRSRDGELETSLNTQGCTTEGDLLFAQKCKELQGFIPPLTDLLNGLKMGRFERGLSSFQQSVAMDRIQRIVGVLQKPQMGERYLGTLLQVEGMLKTWFPQIAAQKSSLGGGKHQLTKHFPSHHSDSAASSPASPMEKMDQTQLGHLALKPKQPWHLTQWPAMNLTWIHTTPICNPPLSSPGTISFSHGPLGTGTGIGVILFLQHGVQPFTHSAPTTPVPPTTASPVIPGEPMKLSGEGPRCYSLPVTLPSDWSYTLSPPSLPTLARKMTIGHREQQRSHPPVAADAHLLNL

SEQ ID NO: 17338 - protein, 385 aa, Homo sapiens; identical to SEQ ID NO: 17336
  Payload ID: 3496
  Gene Symbol: CIART
  Gene Name: circadian associated repressor of transcription
  Uniprot ID: Q8N365
  ENSP ID: ENSP00000358091

SEQ ID NO: 17339 - protein, 238 aa, Homo sapiens
  Payload ID: 3496
  Gene Symbol: CIART
  Gene Name: circadian associated repressor of transcription
  ENSP ID: ENSP00000398291
MAGSGAKRSRDGELETSLNTQGCTTEGDLLFAQKCKELQGFIPPLTDLLNGLKMGRFERGLSSFQQSVAMDRIQRIVGVLQKPQMGERYLGTLLQVEGMLKTWFPQIAAQKSSLGGGKHQLTKHFPSHHSDSAASSPASPMEKMDQTQLGHLALKPKQPWHLTQWPAMNLTWIHTTPICNPPLSSPGTISFSHGPLGTGTGIGVILFLQHGVQPFTHSAPTTPVPPTTASPVIPGEPM

SEQ ID NO: 17340 - protein, 225 aa, Homo sapiens
  Payload ID: 3496
  Gene Symbol: CIART
  Gene Name: circadian associated repressor of transcription
  ENSP ID: ENSP00000406199
MAGSGAKRSRDGELETSLNTQGCTTEGDLLFAQKCKELQGFIPPLTDLLNGLKMGRFERGLSSFQQSVAMDRIQRIVGVLQKPQMGERYLGTLLQVEGMLKTWFPQIAAQKSSLGGGKHQLTKHFPSHHSDSAASSPASPMEKMDQTQLGHLALKPKQPWHLTQWPAMNLTWIHTTPICNPPLSSPGTISFSHGPLGTGTGIGVILFLQHGVQPFTHSAPTTPVP

SEQ ID NO: 17341 - protein, 686 aa, Homo sapiens
  Payload ID: 3497
  Gene Symbol: CIRH1A
  Gene Name: cirrhosis, autosomal recessive 1A (cirhin)
  Uniprot ID: Q969X6
  ENSP ID: ENSP00000327179
MGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 17342 - protein, 571 aa, Homo sapiens
  Payload ID: 3497
  Gene Symbol: CIRH1A
  Gene Name: cirrhosis, autosomal recessive 1A (cirhin)
  Uniprot ID: Q969X6
  ENSP ID: ENSP00000339164
MGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 17343 - protein, 148 aa, Homo sapiens
  Payload ID: 3497
  Gene Symbol: CIRH1A
  Gene Name: cirrhosis, autosomal recessive 1A (cirhin)
  ENSP ID: ENSP00000455269
MGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRI

SEQ ID NO: 17344 - protein, 211 aa, Homo sapiens
  Payload ID: 3497
  Gene Symbol: CIRH1A
  Gene Name: cirrhosis, autosomal recessive 1A (cirhin)
  ENSP ID: ENSP00000456317
KNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQPLLFMDLLDERTLVAVERPLDDIIAQLPPPIKKKKFGT

SEQ ID NO: 17345 - protein, 625 aa, Homo sapiens
  Payload ID: 3497
  Gene Symbol: CIRH1A
  Gene Name: cirrhosis, autosomal recessive 1A (cirhin)
  Uniprot ID: Q969X6
  ENSP ID: ENSP00000456622
MGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLVSSSLLPPKSSSES

SEQ ID NO: 17346 - protein, 700 aa, Homo sapiens
  Payload ID: 3497
  Gene Symbol: CIRH1A
  Gene Name: cirrhosis, autosomal recessive 1A (cirhin)
  ENSP ID: ENSP00000456709
RSTSGAEPESARARGAGAERGEHREGERGAAGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 17347 - protein, 511 aa, Homo sapiens
  Payload ID: 3497
  Gene Symbol: CIRH1A
  Gene Name: cirrhosis, autosomal recessive 1A (cirhin)
  Uniprot ID: Q969X6
  ENSP ID: ENSP00000458843
  MOD_RES (1)..(1): Any amino acid
XSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 17348 - protein, 182 aa, Homo sapiens
  Payload ID: 3497
  Gene Symbol: CIRH1A
  Gene Name: cirrhosis, autosomal recessive 1A (cirhin)
  ENSP ID: ENSP00000461517
MASVDLSYCSFLHLLLLCSPILACPPLNGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVF

SEQ ID NO: 17349 - protein, 78 aa, Homo sapiens
  Payload ID: 3497
  Gene Symbol: CIRH1A
  Gene Name: cirrhosis, autosomal recessive 1A (cirhin)
  ENSP ID: ENSP00000462451
MEYDLQALNIKYAMDAFGGPIWSMAASPSGSQLLVGCEDGSVKLFQITPDKIQFERNFDRQKSRILSLSWHPSGTHIA

SEQ ID NO: 17350 - protein, 198 aa, Homo sapiens
  Payload ID: 3497
  Gene Symbol: CIRH1A
  Gene Name: cirrhosis, autosomal recessive 1A (cirhin)
  ENSP ID: ENSP00000462497
MVFLQFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVAD

SEQ ID NO: 17351 - protein, 142 aa, Homo sapiens
  Payload ID: 3497
  Gene Symbol: CIRH1A
  Gene Name: cirrhosis, autosomal recessive 1A (cirhin)
  ENSP ID: ENSP00000463109
MEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSAT

SEQ ID NO: 17352 - protein, 450 aa, Homo sapiens
  Payload ID: 3497
  Gene Symbol: CIRH1A
  Gene Name: cirrhosis, autosomal recessive 1A (cirhin)
  ENSP ID: ENSP00000487999
  MOD_RES (1)..(1): Any amino acid
XSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLVSSSLLPPKSSSES

SEQ ID NO: 17353 - protein, 511 aa, Homo sapiens; identical to SEQ ID NO: 17347
  Payload ID: 3497
  Gene Symbol: CIRH1A
  Gene Name: cirrhosis, autosomal recessive 1A (cirhin)
  ENSP ID: ENSP00000488036
  MOD_RES (1)..(1): Any amino acid

SEQ ID NO: 17354 - protein, 71 aa, Homo sapiens
  Payload ID: 3497
  Gene Symbol: CIRH1A
  Gene Name: cirrhosis, autosomal recessive 1A (cirhin)
  ENSP ID: ENSP00000488210
  MOD_RES (1)..(1): Any amino acid
XSAVHKMIVDRQYMGVSKRKCIVWGVAFLSDGTIISVDSAGKVQFWDSATGTLVKSHLIANADVQSIAVAD

SEQ ID NO: 17355 - protein, 396 aa, Homo sapiens
  Payload ID: 3497
  Gene Symbol: CIRH1A
  Gene Name: cirrhosis, autosomal recessive 1A (cirhin)
  ENSP ID: ENSP00000488560
  MOD_RES (1)..(1): Any amino acid
XSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 17356 - protein, 50 aa, Homo sapiens
  Payload ID: 3497
  Gene Symbol: CIRH1A
  Gene Name: cirrhosis, autosomal recessive 1A (cirhin)
  ENSP ID: ENSP00000488622
  MOD_RES (1)..(1): Any amino acid
XSAVHKMIVDRQYMGVSKRKCIVWGVAFLSDGTIISVDSAGKVQFWDSAT

SEQ ID NO: 17357 - protein, 211 aa, Homo sapiens; identical to SEQ ID NO: 17344
  Payload ID: 3497
  Gene Symbol: CIRH1A
  Gene Name: cirrhosis, autosomal recessive 1A (cirhin)
  ENSP ID: ENSP00000488731

SEQ ID NO: 17358 - protein, 340 aa, Homo sapiens
  Payload ID: 3498
  Gene Symbol: CLYBL
  Gene Name: citrate lyase beta like
  Uniprot ID: Q8N0X4
  ENSP ID: ENSP00000342991
MALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWFADKFSFHLKGRKLEQPMNLIPFVETAMGLLNFKAVCEETLKVGPQVGLFLDAVVFGGEDFRASIGATSSKETLDILYARQKIVVIAKAFGLQAIDLVYIDFRDGAGLLRQSREGAAMGFTGKQVIHPNQIAVVQEQFSPSPEKIKWAEELIAAFKEHQQLGKGAFTFQGSMIDMPLLKQAQNTVTLATSIKEK

SEQ ID NO: 17359 - protein, 306 aa, Homo sapiens
  Payload ID: 3498
  Gene Symbol: CLYBL
  Gene Name: citrate lyase beta like
  Uniprot ID: Q8N0X4
  ENSP ID: ENSP00000365532
MALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWAVCEETLKVGPQVGLFLDAVVFGGEDFRASIGATSSKETLDILYARQKIVVIAKAFGLQAIDLVYIDFRDGAGLLRQSREGAAMGFTGKQVIHPNQIAVVQEQFSPSPEKIKWAEELIAAFKEHQQLGKGAFTFQGSMIDMPLLKQAQNTVTLATSIKEK

SEQ ID NO: 17360 - protein, 340 aa, Homo sapiens; identical to SEQ ID NO: 17358
  Payload ID: 3498
  Gene Symbol: CLYBL
  Gene Name: citrate lyase beta like
  Uniprot ID: Q8N0X4
  ENSP ID: ENSP00000365533

SEQ ID NO: 17361 - protein, 89 aa, Homo sapiens
  Payload ID: 3498
  Gene Symbol: CLYBL
  Gene Name: citrate lyase beta like
  ENSP ID: ENSP00000389062
EELIAAFKEHQQLGKVGRYCCSWLCIQPFPSSPGQRSQSISRVPGRYWVLGARSWESKGAFTFQGSMIDMPLLKQAQNTVTLATSIKEK

SEQ ID NO: 17362 - protein, 103 aa, Homo sapiens
  Payload ID: 3498
  Gene Symbol: CLYBL
  Gene Name: citrate lyase beta like
  ENSP ID: ENSP00000396574
LQAIDLVYIDFRDGAGLLRQSREGAAMGFTGKQVIHPNQIAVVQEQFSPSPEKIKWAEELIAAFKEHQQLGKGAFTFQGSMIDMPLLKQAQNTVTLATSIKEK

SEQ ID NO: 17363 - protein, 147 aa, Homo sapiens
  Payload ID: 3498
  Gene Symbol: CLYBL
  Gene Name: citrate lyase beta like
  ENSP ID: ENSP00000401586
NEARLRIVKTLEDIDLGPTEKCVRVNSVSSGLAEEDLETLLQSRVLPSSLMLPKVESPEEIQWAVCEETLKVGPQVGLFLDAVVFGGEDFRASIGVKDISLSLFLCVCVYMCVYIFSLPLKDGHLHNNVYLPTMTMVFHDNGMDTTS

SEQ ID NO: 17364 - protein, 181 aa, Homo sapiens
  Payload ID: 3498
  Gene Symbol: CLYBL
  Gene Name: citrate lyase beta like
  ENSP ID: ENSP00000403408
NEARLRIVKTLEDIDLGPTEKCVRVNSVSSGLAEEDLETLLQSRVLPSSLMLPKVESPEEIQWFADKFSFHLKGRKLEQPMNLIPFVETAMGLLNFKAVCEETLKVGPQVGLFLDAVVFGGEDFRASIGVKDISLSLFLCVCVYMCVYIFSLPLKDGHLHNNVYLPTMTMVFHDNGMDTTS

SEQ ID NO: 17365 - protein, 466 aa, Homo sapiens [sequence omitted]

SEQ ID NO: 17366 - protein, 453 aa, Homo sapiens
  Payload ID: 3499
  Gene Symbol: CS
  Gene Name: citrate synthase
  ENSP ID: ENSP00000440543
MNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLIAKLPCVAAKIYRNLYREGSGIGAIDSNLDWSHNFTNMLGYTDHQFTELTRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERPKSMSTEGLMKFVDSKSG

SEQ ID NO: 17367 - protein, 190 aa, Homo sapiens
  Payload ID: 3499
  Gene Symbol: CS
  Gene Name: citrate synthase
  ENSP ID: ENSP00000446492
LADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWEQRSTEISTEKAAVLGPLTLTWTGLTISPTC

SEQ ID NO: 17368 - protein, 400 aa, Homo sapiens
  Payload ID: 3499
  Gene Symbol: CS
  Gene Name: citrate synthase
  ENSP ID: ENSP00000446779
MMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLIAKLPCVAAKIYRNLYREGSGIGAIDSNLDWSHNFTNMLGYTDHQFTELTRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERPKSMSTEGLMKFVDSKSG

SEQ ID NO: 17369 - protein, 80 aa, Homo sapiens
  Payload ID: 3499
  Gene Symbol: CS
  Gene Name: citrate synthase
  ENSP ID: ENSP00000447346
MMYGGMRGMKGLVYETSVLDPDEGIRFRGFSIPECQKLLPKAKGGEEPLPEGLFWLLVTGHIPTEEQVSWLSKEWAKRAA

SEQ ID NO: 17370 - protein, 157 aa, Homo sapiens
  Payload ID: 3499
  Gene Symbol: CS
  Gene Name: citrate synthase
  ENSP ID: ENSP00000447442
MALLTAAARLLGTKNASCLVLAARHASASSTMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTK

SEQ ID NO: 17371 - protein, 75 aa, Homo sapiens
  Payload ID: 3499
  Gene Symbol: CS
  Gene Name: citrate synthase
  ENSP ID: ENSP00000447582
MALLTAAARLLGTKNASCLVLAARHASASSTNLKDILADLIPKEQARIKTFRQQHGKTVVGQITVDMACCSGSCL

SEQ ID NO: 17372 - protein, 142 aa, Homo sapiens
  Payload ID: 3499
  Gene Symbol: CS
  Gene Name: citrate synthase
  ENSP ID: ENSP00000447948
MALLTAAARLLGTKNASCLVLAARHASASSTNLKDILADLIPKEQARIKTFRQQHGKTVVGQITVDMMYGGMRGMKGLVYETSVLDPDEGLFWLLVTGHIPTEEQVSWLSKEWAKRAALPSHVVTMLDNFPTNLHPMSQLSA

SEQ ID NO: 17373 - protein, 149 aa, Homo sapiens
  Payload ID: 3499
  Gene Symbol: CS
  Gene Name: citrate synthase
  ENSP ID: ENSP00000447986
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQLIYEDSMDLIAKLPCV

SEQ ID NO: 17374 - protein, 66 aa, Homo sapiens
  Payload ID: 3499
  Gene Symbol: CS
  Gene Name: citrate synthase
  ENSP ID: ENSP00000448166
MMYGGMRGMKGLVYETSVLDPDEGIRFRGFSIPECQKLLPKAKGGEEPLPEGLFWLLVTGHIPTEE

SEQ ID NO: 17375 - protein, 178 aa, Homo sapiens
  Payload ID: 3499
  Gene Symbol: CS
  Gene Name: citrate synthase
  ENSP ID: ENSP00000448172
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSE

SEQ ID NO: 17376 - protein, 117 aa, Homo sapiens
  Payload ID: 3499
  Gene Symbol: CS
  Gene Name: citrate synthase
  ENSP ID: ENSP00000448409
MMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFAR

SEQ ID NO: 17377 - protein, 140 aa, Homo sapiens
  Payload ID: 3499
  Gene Symbol: CS
  Gene Name: citrate synthase
  ENSP ID: ENSP00000448667
MALLTAAARLLGTKGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLIAKLPCVAAK

SEQ ID NO: 17378 - protein, 144 aa, Homo sapiens
  Payload ID: 3499
  Gene Symbol: CS
  Gene Name: citrate synthase
  ENSP ID: ENSP00000449025
MMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLIAKLP

SEQ ID NO: 17379 - protein, 123 aa, Homo sapiens
  Payload ID: 3499
  Gene Symbol: CS
  Gene Name: citrate synthase
  ENSP ID: ENSP00000449080
LRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERKD

SEQ ID NO: 17380 - protein, 120 aa, Homo sapiens
  Payload ID: 3499
  Gene Symbol: CS
  Gene Name: citrate synthase
  ENSP ID: ENSP00000449427
MMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYA

SEQ ID NO: 17381 - protein, 132 aa, Homo sapiens
  Payload ID: 3499
  Gene Symbol: CS
  Gene Name: citrate synthase
  ENSP ID: ENSP00000449491
MALLTAAARLLGTKNASCLVLAARHASASSTNLKDILADLIPKEQARIKTFRQQHGKTVVGQITVDMGIRFRGFSIPECQKLLPKAKGGEEPLPEGLFWLLVTGHIPTEEQVSWLSKEWAKRAALPSHVVTM

SEQ ID NO: 17382 - protein, 49 aa, Homo sapiens
  Payload ID: 3499
  Gene Symbol: CS
  Gene Name: citrate synthase
  ENSP ID: ENSP00000449571
MALLTAAARLLGTKNASCLVLAATWQDGGGPNHCGHDVWWHERHEGIGL

SEQ ID NO: 17383 - protein, 114 aa, Homo sapiens
  Payload ID: 3499
  Gene Symbol: CS
  Gene Name: citrate synthase
  ENSP ID: ENSP00000449753
MMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESN

SEQ ID NO: 17384 - protein, 140 aa, Homo sapiens
  Payload ID: 3499
  Gene Symbol: CS
  Gene Name: citrate synthase
  ENSP ID: ENSP00000450101
MMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLI

SEQ ID NO: 17385 - protein, 144 aa, Homo sapiens; identical to SEQ ID NO: 17378
  Payload ID: 3499
  Gene Symbol: CS
  Gene Name: citrate synthase
  ENSP ID: ENSP00000450312

SEQ ID NO: 17386 - protein, 146 aa, Homo sapiens
  Payload ID: 3499
  Gene Symbol: CS
  Gene Name: citrate synthase
  ENSP ID: ENSP00000450403
MALLTAAARLLGTKNASCLVLAARHASASSTNLKDILADLIPKEQARIKTFRQQHGKTVVGQITVDMVSWLSKEWAKRAALPSHVVTMLDNFPTNLHPMSQLSAAVTALNSESNFARAYAQGISRTKYWELIYEDSMDLIAKLPCV

SEQ ID NO: 17387 - protein, 2027 aa, Homo sapiens
  Payload ID: 3500
  Gene Symbol: CIT
  Gene Name: citron rho-interacting serine/threonine kinase
  Uniprot ID: O14578
  ENSP ID: ENSP00000261833
MLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVMEYQPGGDLLSLLNRYEDQLDENLIQFYLAELILAVHSVHLMGYVHRDIKPENILVDRTGHIKLVDFGSAAKMNSNKMVNAKLPIGTPDYMAPEVLTVMNGDGKGTYGLDCDWWSVGVIAYEMIYGRSPFAEGTSARTFNNIMNFQRFLKFPDDPKVSSDFLDLIQSLLCGQKERLKFEGLCCHPFFSKIDWNNIRNSPPPFVPTLKSDDDTSNFDEPEKNSWVSSSPCQLSPSGFSGEELPFVGFSYSKALGILGRSESVVSGLDSPAKTSSMEKKLLIKSKELQDSQDKCHKMEQEMTRLHRRVSEVEAVLSQKEVELKASETQRSLLEQDLATYITECSSLKRSLEQARMEVSQEDDKALQLLHDIREQSRKLQEIKEQEYQAQVEEMRLMMNQLEEDLVSARRRSDLYESELRESRLAAEEFKRKATECQHKLLKAKDQGKPEVGEYAKLEKINAEQQLKIQELQEKLEKAVKASTEATELLQNIRQAKERAERELEKLQNREDSSEGIRKKLVEAEELEEKHREAQVSAQHLEVHLKQKEQHYEEKIKVLDNQIKKDLADKETLENMMQRHEEEAHEKGKILSEQKAMINAMDSKIRSLEQRIVELSEANKLAANSSLFTQRNMKAQEEMISELRQQKFYLETQAGKLEAQNRKLEEQLEKISHQDHSDKNRLLELETRLREVSLEHEEQKLELKRQLTELQLSLQERESQLTALQAARAALESQLRQAKTELEETTAEAEEEIQALTAHRDEIQRKFDALRNSCTVITDLEEQLNQLTEDNAELNNQNFYLSKQLDEASGANDEIVQLRSEVDHLRREITEREMQLTSQKQTMEALKTTCTMLEEQVMDLEALNDELLEKERQWEAWRSVLGDEKSQFECRVRELQRMLDTEKQSRARADQRITESRQVVELAVKEHKAEILALQQALKEQKLKAESLSDKLNDLEKKHAMLEMNARSLQQKLETERELKQRLLEEQAKLQQQMDLQKNHIFRLTQGLQEALDRADLLKTERSDLEYQLENIQVLYSHEKVKMEGTISQQTKLIDFLQAKMDQPAKKKKGLFSRRKEDPALPTQVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNENLSKYCIRKEIETSEPCSCIHFTNYSILIGTNKFYEIDMKQYTLEEFLDKNDHSLAPAVFAASSNSFPVSIVQVNSAGQREEYLLCFHEFGVFVDSYGRRSRTDDLKWSRLPLAFAYREPYLFVTHFNSLEVIEIQARSSAGTPARAYLDIPNPRYLGPAISSGAIYLASSYQDKLRVICCKGNLVKESGTEHHRGPSTSRSSPNKRGPPTYNEHITKRVASSPAPPEGPSHPREPSTPHRYREGRTELRRDKSPGRPLEREKSPGRMLSTRRERSPGRLFEDSSRGRLPAGAVRTPLSQVNKVWDQSSV

SEQ ID NO: 17388 - protein, 1640 aa, Homo sapiens
  Payload ID: 3500
  Gene Symbol: CIT
  Gene Name: citron rho-interacting serine/threonine kinase
  ENSP ID: ENSP00000376305
  MOD_RES (1)..(1): Any amino acid
XPFVPTLKSDDDTSNFDEPEKNSWVSSSPCQLSPSGFSGEELPFVGFSYSKALGILGRSESVVSGLDSPAKTSSMEKKLLIKSKELQDSQDKCHKMEQEMTRLHRRVSEVEAVLSQKEVELKASETQRSLLEQDLATYITECSSLKRSLEQARMEVSQEDDKALQLLHDIREQSRKLQEIKEQEYQAQVEEMRLMMNQLEEDLVSARRRSDLYESELRESRLAAEEFKRKATECQHKLLKAKDQGKPEVGEYAKLEKINAEQQLKIQELQEKLEKAVKASTEATELLQNIRQAKERAERELEKLQNREDSSEGIRKKLVEAEELEEKHREAQVSAQHLEVHLKQKEQHYEEKIKVLDNQIKKDLADKETLENMMQRHEEEAHEKGKILSEQKAMINAMDSKIRSLEQRIVELSEANKLAANSSLFTQRNMKAQEEMISELRQQKFYLETQAGKLEAQNRKLEEQLEKISHQDHSDKNRLLELETRLREVSLEHEEQKLELKRQLTELQLSLQERESQLTALQAARAALESQLRQAKTELEETTAEAEEEIQALTAHRDEIQRKFDALRNSCTVITDLEEQLNQLTEDNAELNNQNFYLSKQLDEASGANDEIVQLRSEVDHLRREITEREMQLTSQKQTMEALKTTCTMLEEQVMDLEALNDELLEKERQWEAWRSVLGDEKSQFECRVRELQRMLDTEKQSRARADQRITESRQVVELAVKEHKAEILALQQALKEQKLKAESLSDKLNDLEKKHAMLEMNARSLQQKLETERELKQRLLEEQAKLQQQMDLQKNHIFRLTQGLQEALDRADLLKTERSDLEYQLENIQVLYSHEKVKMEGTISQQTKLIDFLQAKMDQPAKKKKVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNENLSKYCIRKEIETSEPCSCIHFTNYSILIGTNKFYEIDMKQYTLEEFLDKNDHSLAPAVFAASSNSFPVSIVQVNSAGQREEYLLCFHEFGVFVDSYGRRSRTDDLKWSRLPLAFAYREPYLFVTHFNSLEVIEIQARSSAGTPARAYLDIPNPRYLGPAISSGAIYLASSYQDKLRVICCKGNLVKESGTEHHRGPSTSRSSPNKRGPPTYNEHITKRVASSPAPPEGPSHPREPSTPHRYREGRTELRRDKSPGRPLEREKSPGRMLSTRRERSPGRLFEDSSRGRLPAGAVRTPLSQVNKVWDQSSV

SEQ ID NO: 17389 - protein, 2069 aa, Homo sapiens
  Payload ID: 3500
  Gene Symbol: CIT
  Gene Name: citron rho-interacting serine/threonine kinase
  Uniprot ID: O14578
  ENSP ID: ENSP00000376306
MLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVMEYQPGGDLLSLLNRYEDQLDENLIQFYLAELILAVHSVHLMGYVHRDIKPENILVDRTGHIKLVDFGSAAKMNSNKMVNAKLPIGTPDYMAPEVLTVMNGDGKGTYGLDCDWWSVGVIAYEMIYGRSPFAEGTSARTFNNIMNFQRFLKFPDDPKVSSDFLDLIQSLLCGQKERLKFEGLCCHPFFSKIDWNNIRNSPPPFVPTLKSDDDTSNFDEPEKNSWVSSSPCQLSPSGFSGEELPFVGFSYSKALGILGRSESVVSGLDSPAKTSSMEKKLLIKSKELQDSQDKCHKMEQEMTRLHRRVSEVEAVLSQKEVELKASETQRSLLEQDLATYITECSSLKRSLEQARMEVSQEDDKALQLLHDIREQSRKLQEIKEQEYQAQVEEMRLMMNQLEEDLVSARRRSDLYESELRESRLAAEEFKRKATECQHKLLKAKDQGKPEVGEYAKLEKINAEQQLKIQELQEKLEKAVKASTEATELLQNIRQAKERAERELEKLQNREDSSEGIRKKLVEAEERRHSLENKVKRLETMERRENRLKDDIQTKSQQIQQMADKILELEEKHREAQVSAQHLEVHLKQKEQHYEEKIKVLDNQIKKDLADKETLENMMQRHEEEAHEKGKILSEQKAMINAMDSKIRSLEQRIVELSEANKLAANSSLFTQRNMKAQEEMISELRQQKFYLETQAGKLEAQNRKLEEQLEKISHQDHSDKNRLLELETRLREVSLEHEEQKLELKRQLTELQLSLQERESQLTALQAARAALESQLRQAKTELEETTAEAEEEIQALTAHRDEIQRKFDALRNSCTVITDLEEQLNQLTEDNAELNNQNFYLSKQLDEASGANDEIVQLRSEVDHLRREITEREMQLTSQKQTMEALKTTCTMLEEQVMDLEALNDELLEKERQWEAWRSVLGDEKSQFECRVRELQRMLDTEKQSRARADQRITESRQVVELAVKEHKAEILALQQALKEQKLKAESLSDKLNDLEKKHAMLEMNARSLQQKLETERELKQRLLEEQAKLQQQMDLQKNHIFRLTQGLQEALDRADLLKTERSDLEYQLENIQVLYSHEKVKMEGTISQQTKLIDFLQAKMDQPAKKKKGLFSRRKEDPALPTQVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNENLSKYCIRKEIETSEPCSCIHFTNYSILIGTNKFYEIDMKQYTLEEFLDKNDHSLAPAVFAASSNSFPVSIVQVNSAGQREEYLLCFHEFGVFVDSYGRRSRTDDLKWSRLPLAFAYREPYLFVTHFNSLEVIEIQARSSAGTPARAYLDIPNPRYLGPAISSGAIYLASSYQDKLRVICCKGNLVKESGTEHHRGPSTSRSSPNKRGPPTYNEHITKRVASSPAPPEGPSHPREPSTPHRYREGRTELRRDKSPGRPLEREKSPGRMLSTRRERSPGRLFEDSSRGRLPAGAVRTPLSQVNKVWDQSSV

SEQ ID NO: 17390 - protein, 109 aa, Homo sapiens
  Payload ID: 3500
  Gene Symbol: CIT
  Gene Name: citron rho-interacting serine/threonine kinase
  ENSP ID: ENSP00000443199
IAELQELQPSAKDFEVRSLVGCGHFAEVQVVREKATGDIYAMKVMKKKALLAQEQVSFFEEERNILSRSTSPWIPQLQYAFQDKNHLYLVLYSHEKVKMEGTISQQTKL

SEQ ID NO: 17391 - protein, 162 aa, Homo sapiens
  Payload ID: 3500
  Gene Symbol: CIT
  Gene Name: citron rho-interacting serine/threonine kinase
  ENSP ID: ENSP00000446105
MRLLAPTTRLYNCEVKWTISAGRSRNERCSLPARSKKSLFKDKAQISATDLQTMEALKTTCTMLEEQVMDLEALNDELLEKERQWEAWRSVLGDEKSQFECRVRELQRMLDTEKQSRARADQRITESRQVVELAVKEHKAEILALQQALKEQKLKAESLSDK

SEQ ID NO: 17392 - protein, 482 aa, Homo sapiens
  Payload ID: 3500
  Gene Symbol: CIT
  Gene Name: citron rho-interacting serine/threonine kinase
  Uniprot ID: O14578
  ENSP ID: ENSP00000482318
MLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVMEYQPGGDLLSLLNRYEDQLDENLIQFYLAELILAVHSVHLMGYVHRDIKPENILVDRTGHIKLVDFGSAAKMNSNKMVNAKLPIGTPDYMAPEVLTVMNGDGKGTYGLDCDWWSVGVIAYEMIYGRSPFAEGTSARTFNNIMNFQRFLKFPDDPKVSSDFLDLIQSLLCGQKERLKFEGLCCHPFFSKIDWNNIRNSPPPFVPTLKSDDDTSNFDEPEKNSWVSSSPCQLSPSGFSGEELPFVGFSYSKALGILGRSESVVSGLDSPAKTSSMEKKLLIKSKELQDSQDKCHKMEQEMTRLHRRVSGG

SEQ ID NO: 17393 - protein, 64 aa, Homo sapiens
  Payload ID: 3501
  Gene Symbol: CKLF-CMTM1
  Gene Name: CKLF-CMTM1 readthrough
  ENSP ID: ENSP00000433503
INSLVTTVFMLIVSVLALIPETTTLTVGGGDLTNSIITAVFLSVVAILAMQEKKRRHLLYVGGR

SEQ ID NO: 17394 - protein, 60 aa, Homo sapiens
  Payload ID: 3501
  Gene Symbol: CKLF-CMTM1
  Gene Name: CKLF-CMTM1 readthrough
  ENSP ID: ENSP00000433857
MDNVQPKIKHRPFCFSVKGHVKMLRLDIINSLVTTVFMLIVSVLALIPETTTLTVGGGLF

SEQ ID NO: 17395 - protein, 115 aa, Homo sapiens
  Payload ID: 3501
  Gene Symbol: CKLF-CMTM1
  Gene Name: CKLF-CMTM1 readthrough
  ENSP ID: ENSP00000433998
MDNVQPKIKHRPFCFSVKGHVKMLRLDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 17396 - protein, 33 aa, Homo sapiens; identical to SEQ ID NO: 14785
  Payload ID: 3501
  Gene Symbol: CKLF-CMTM1
  Gene Name: CKLF-CMTM1 readthrough
  ENSP ID: ENSP00000435007

SEQ ID NO: 17397 - protein, 168 aa, Homo sapiens
  Payload ID: 3501
  Gene Symbol: CKLF-CMTM1
  Gene Name: CKLF-CMTM1 readthrough
  ENSP ID: ENSP00000479319
MDNVQPKIKHRPFCFSVKGHVKMLRLALTVTSMTFFIIAQAPEPYIVITGFEVTVILFFILLYVLRLDRLMKWLFWPLLDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 17398 - protein, 92 aa, Homo sapiens
  Payload ID: 3501
  Gene Symbol: CKLF-CMTM1
  Gene Name: CKLF-CMTM1 readthrough
  ENSP ID: ENSP00000484781
MDNVQPKIKHRPFCFSVKGHVKMLRLDIINSLVTTVFMLIVSVLALIPETTTLTVGGGDLTNSIITAVFLSVVAILAMQEKKRRHLLYVGGR

SEQ ID NO: 17399 - protein, 231 aa, Homo sapiens
  Payload ID: 3502
  Gene Symbol: CMTM1
  Gene Name: CKLF-like MARVEL transmembrane domain containing 1
  ENSP ID: ENSP00000330061
MDPEHAKPESSEAPSGNLKQPETAAALASSGSVVSSVPKAQRNISAKTAPRKHPAVSIRSAQSAAAARPQGSEGTAPSRKATTRPPPKPTLPPPTPSAHTESKLLNEMAIKERVEGRAKVPYKFRDSLKRFSFSPTGMLKILRLSLILGALACFIITQANESFITITSLEICIVVFFILIYVLTLHHLLTYLHWPLLDLTNSIITAVFLSVVAILAMQEKKRRHLLYVGGR

SEQ ID NO: 17400 - protein, 122 aa, Homo sapiens
  Payload ID: 3502
  Gene Symbol: CMTM1
  Gene Name: CKLF-like MARVEL transmembrane domain containing 1
  Uniprot ID: Q8IZ96
  ENSP ID: ENSP00000331428
MDPEHAKPESSEAPSGNLKQPETAAALASSGSVDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 17401 - protein, 91 aa, Homo sapiens
  Payload ID: 3502
  Gene Symbol: CMTM1
  Gene Name: CKLF-like MARVEL transmembrane domain containing 1
  Uniprot ID: Q8IZ96
  ENSP ID: ENSP00000331494
MDPEHAKPESSEAPSGNLKQPETAAALSLILGALACFIITQANESFITITSLEICIVVFFILIYVLTLHHLLTYLHWPLLNAEYRKQTKQI

SEQ ID NO: 17402 - protein, 116 aa, Homo sapiens
  Payload ID: 3502
  Gene Symbol: CMTM1
  Gene Name: CKLF-like MARVEL transmembrane domain containing 1
  Uniprot ID: Q8IZ96
  ENSP ID: ENSP00000337119
MDPEHAKPESSEAPSGNLKQPETAAALDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 17403 - protein, 286 aa, Homo sapiens
  Payload ID: 3502
  Gene Symbol: CMTM1
  Gene Name: CKLF-like MARVEL transmembrane domain containing 1
  Uniprot ID: Q8IZ96
  ENSP ID: ENSP00000368814
MDPEHAKPESSEAPSGNLKQPETAAALASSGSVVSSVPKAQRNISAKTAPRKHPAVSIRSAQSAAAARPQGSEGTAPSRKATTRPPPKPTLPPPTPSAHTESKLLNEMAIKERVEGRAKVPYKFRDSLKRFSFSPTGMLKILRLSLILGALACFIITQANESFITITSLEICIVVFFILIYVLTLHHLLTYLHWPLLDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 17404 - protein, 169 aa, Homo sapiens
  Payload ID: 3502
  Gene Symbol: CMTM1
  Gene Name: CKLF-like MARVEL transmembrane domain containing 1
  Uniprot ID: Q8IZ96
  ENSP ID: ENSP00000405729
MDPEHAKPESSEAPSGNLKQPETAAALSLILGALACFIITQANESFITITSLEICIVVFFILIYVLTLHHLLTYLHWPLLDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 17405 - protein, 131 aa, Homo sapiens
  Payload ID: 3502
  Gene Symbol: CMTM1
  Gene Name: CKLF-like MARVEL transmembrane domain containing 1
  ENSP ID: ENSP00000431135
  MOD_RES (1)..(1): Any amino acid
XRKATTRPPPKPTLPPPTPSAHTESKLLNEMAIKERVEGRAKVPYKFRDSLKRFSFSPTGMLKILRLSLILGALACFIITQANESFITITSLEICIVVFFILIYVLTLHHLLTYLHWPLLNAEYRKQTKQI

SEQ ID NO: 17406 - protein, 38 aa, Homo sapiens
  Payload ID: 3502
  Gene Symbol: CMTM1
  Gene Name: CKLF-like MARVEL transmembrane domain containing 1
  Uniprot ID: Q8IZ96
  ENSP ID: ENSP00000431303
MDPEHAKPESSEAPSGNLKQPETAAALEADKANMSNFN

SEQ ID NO: 17407 - protein, 131 aa, Homo sapiens; identical to SEQ ID NO: 17405
  Payload ID: 3502
  Gene Symbol: CMTM1
  Gene Name: CKLF-like MARVEL transmembrane domain containing 1
  ENSP ID: ENSP00000431609
  MOD_RES (1)..(1): Any amino acid

SEQ ID NO: 17408 - protein, 32 aa, Homo sapiens
  Payload ID: 3502
  Gene Symbol: CMTM1
  Gene Name: CKLF-like MARVEL transmembrane domain containing 1
  Uniprot ID: Q8IZ96
  ENSP ID: ENSP00000432387
MDPEHAKPESSEAPSGNLKQPETAAALLCSFQ

SEQ ID NO: 17409 - protein, 114 aa, Homo sapiens
  Payload ID: 3502
  Gene Symbol: CMTM1
  Gene Name: CKLF-like MARVEL transmembrane domain containing 1
  Uniprot ID: Q8IZ96
  ENSP ID: ENSP00000432398
MDPEHAKPESSEAPSGNLKQPETAAALSLILGALACFIITQANESFITITSLEICIVVFFILIYVLTLHHLLTYLHWPLLDLTNSIITAVFLSVVAILAMQEKKRRHLLYVGGR

SEQ ID NO: 17410 - protein, 61 aa, Homo sapiens
  Payload ID: 3502
  Gene Symbol: CMTM1
  Gene Name: CKLF-like MARVEL transmembrane domain containing 1
  Uniprot ID: Q8IZ96
  ENSP ID: ENSP00000432687
MDPEHAKPESSEAPSGNLKQPETAAALDLTNSIITAVFLSVVAILAMQEKKRRHLLYVGGR

SEQ ID NO: 17411 - protein, 131 aa, Homo sapiens; identical to SEQ ID NO: 17405
  Payload ID: 3502
  Gene Symbol: CMTM1
  Gene Name: CKLF-like MARVEL transmembrane domain containing 1
  ENSP ID: ENSP00000433160
  MOD_RES (1)..(1): Any amino acid

SEQ ID NO: 17412 - protein, 70 aa, Homo sapiens
  Payload ID: 3502
  Gene Symbol: CMTM1
  Gene Name: CKLF-like MARVEL transmembrane domain containing 1
  ENSP ID: ENSP00000434434
MQEKKRRHLLYVGGSLCLTAVIVCCIDAFVVTTKMRTNLKRFLGVEVERKLSPAKDAYPETGPDAPQRPA

SEQ ID NO: 17413 - protein, 28 aa, Homo sapiens
  Payload ID: 3502
  Gene Symbol: CMTM1
  Gene Name: CKLF-like MARVEL transmembrane domain containing 1
  Uniprot ID: Q8IZ96
  ENSP ID: ENSP00000435020
MDPEHAKPESSEAPSGNLKQPETAAALR

SEQ ID NO: 17414 - protein, 131 aa, Homo sapiens; identical to SEQ ID NO: 17405
  Payload ID: 3502
  Gene Symbol: CMTM1
  Gene Name: CKLF-like MARVEL transmembrane domain containing 1
  ENSP ID: ENSP00000435208
  MOD_RES (1)..(1): Any amino acid

SEQ ID NO: 17415 - protein, 131 aa, Homo sapiens; identical to SEQ ID NO: 17405
  Payload ID: 3502
  Gene Symbol: CMTM1
  Gene Name: CKLF-like MARVEL transmembrane domain containing 1
  ENSP ID: ENSP00000435485
  MOD_RES (1)..(1): Any amino acid

SEQ ID NO: 17416 - protein, 91 aa, Homo sapiens; identical to SEQ ID NO: 17401
  Payload ID: 3502
  Gene Symbol: CMTM1
  Gene Name: CKLF-like MARVEL transmembrane domain containing 1
  Uniprot ID: Q8IZ96
  ENSP ID: ENSP00000435755

SEQ ID NO: 17417 - protein, 238 aa, Homo sapiens
  Payload ID: 3502
  Gene Symbol: CMTM1
  Gene Name: CKLF-like MARVEL transmembrane domain containing 1
  ENSP ID: ENSP00000435786
MDPEHAKPESSEAPSGNLKQPETAAALASSGSVVSSVPKAQRNISAKTAPRKHPAVSIRSAQSAAAARPQGSEGTAPSRKATTRPPPKPTLPPPTPSAHTESKLLNEMAIKERVEGRAKVPYKFRDSLKRFSFSPTGMLKILRLVSGELDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 17418 - protein, 38 aa, Homo sapiens; identical to SEQ ID NO: 17406
  Payload ID: 3502
  Gene Symbol: CMTM1
  Gene Name: CKLF-like MARVEL transmembrane domain containing 1
  Uniprot ID: Q8IZ96
  ENSP ID: ENSP00000437079

SEQ ID NO: 17419 - protein, 248 aa, Homo sapiens
  Payload ID: 3503
  Gene Symbol: CMTM2
  Gene Name: CKLF-like MARVEL transmembrane domain containing 2
  Uniprot ID: Q8TAZ6
  ENSP ID: ENSP00000268595
MAPKAAKGAKPEPAPAPPPPGAKPEEDKKDGKEPSDKPQKAVQDHKEPSDKPQKAVQPKHEVGTRRGCRRYRWELKDSNKEFWLLGHAEIKIRSLGCLIAAMILLSSLTVHPILRLIITMEISFFSFFILLYSFAIHRYIPFILWPISDLFNDLIACAFLVGAVVFAVRSRRSMNLHYLLAVILIGAAGVFAFIDVCLQRNHFRGKKAKKHMLVPPPGKEKGPQQGKGPEPAKPPEPGKPPGPAKGKK

SEQ ID NO: 17420 - protein, 195 aa, Homo sapiens
  Payload ID: 3503
  Gene Symbol: CMTM2
  Gene Name: CKLF-like MARVEL transmembrane domain containing 2
  Uniprot ID: Q8TAZ6
  ENSP ID: ENSP00000368800
MAPKAAKGAKPEPAPAPPPPGAKPEEDKKDGKEPSDKPQKAVQDHKEPSDKPQKAVQPKHEVGTRRGCRRYRWELKDSNKEFWLLGHAEIKIRSLDLFNDLIACAFLVGAVVFAVRSRRSMNLHYLLAVILIGAAGVFAFIDVCLQRNHFRGKKAKKHMLVPPPGKEKGPQQGKGPEPAKPPEPGKPPGPAKGKK

SEQ ID NO: 17421 - protein, 51 aa, Homo sapiens
  Payload ID: 3503
  Gene Symbol: CMTM2
  Gene Name: CKLF-like MARVEL transmembrane domain containing 2
  ENSP ID: ENSP00000454319
MAPKAAKGAKPEPAPAPPPPGAKPEEDKKDALPFIDTYPSSCGPFLTSSTT

SEQ ID NO: 17422 - protein, 182 aa, Homo sapiens
  Payload ID: 3504
  Gene Symbol: CMTM3
  Gene Name: CKLF-like MARVEL transmembrane domain containing 3
  Uniprot ID: Q96MX0
  ENSP ID: ENSP00000354579
MWPPDPDPDPDPEPAGGSRPGPAVPGLRALLPARAFLCSLKGRLLLAESGLSFITFICYVASSASAFLTAPLLEFLLALYFLFADAMQLNDKWQGLCWPMMDFLRCVTAALIYFAISITAIAKYSDGASKAAGVFGFFATIVFATDFYLIFNDVAKFLKQGDSADETTAHKTEEENSDSDSD

SEQ ID NO: 17423 - protein, 182 aa, Homo sapiens; identical to SEQ ID NO: 17422
  Payload ID: 3504
  Gene Symbol: CMTM3
  Gene Name: CKLF-like MARVEL transmembrane domain containing 3
  Uniprot ID: Q96MX0
  ENSP ID: ENSP00000400482

SEQ ID NO: 17424 - protein, 122 aa, Homo sapiens
  Payload ID: 3504
  Gene Symbol: CMTM3
  Gene Name: CKLF-like MARVEL transmembrane domain containing 3
  ENSP ID: ENSP00000454628
MWPPDPDPDPDPEPAGGSRPGPAVPGLRALLPARAFLCSLKGRLLLAESGLSFITFICYVASSASAFLTAPLLEFLLALYFLFADAMQLNDKWQGLCWPMMDFLRCVTAALIYFAISITAIA

SEQ ID NO: 17425 - protein, 182 aa, Homo sapiens; identical to SEQ ID NO: 17422
  Payload ID: 3504
  Gene Symbol: CMTM3
  Gene Name: CKLF-like MARVEL transmembrane domain containing 3
  Uniprot ID: Q96MX0
  ENSP ID: ENSP00000455758

SEQ ID NO: 17426 - protein, 182 aa, Homo sapiens; identical to SEQ ID NO: 17422
  Payload ID: 3504
  Gene Symbol: CMTM3
  Gene Name: CKLF-like MARVEL transmembrane domain containing 3
  Uniprot ID: Q96MX0
  ENSP ID: ENSP00000455851

SEQ ID NO: 17427 - protein, 59 aa, Homo sapiens
  Payload ID: 3504
  Gene Symbol: CMTM3
  Gene Name: CKLF-like MARVEL transmembrane domain containing 3
  Uniprot ID: Q96MX0
  ENSP ID: ENSP00000456426
MWPPDPDPDPDPEPAGGSRPGPAVPGLRALLPARAFLCSLKGPGGFVCTWCSCPHQPLW

SEQ ID NO: 17428 - protein, 116 aa, Homo sapiens
  Payload ID: 3504
  Gene Symbol: CMTM3
  Gene Name: CKLF-like MARVEL transmembrane domain containing 3
  ENSP ID: ENSP00000457451
MWPPDPDPDPDPEPAGGSRPGPAVPGLRALLPARAFLCSLKGRLLLAESGLSFITFICYVASSASAFLTAPLLEFLLALYFLFADAMQLNDKWQGLCWPMMDFLRCVTAALIYFAI

SEQ ID NO: 17429 - protein, 150 aa, Homo sapiens
  Payload ID: 3504
  Gene Symbol: CMTM3
  Gene Name: CKLF-like MARVEL transmembrane domain containing 3
  ENSP ID: ENSP00000457589
MWPPDPDPDPDPEPAGGSRPGPAVPGLRALLPARAFLCSLKGRLLLAESGLSFITFICYVASSASAFLTAPLLEFLLALYFLFADAMQLNDKWQGLCWPMMVFGFFATIVFATDFYLIFNDVAKFLKQGDSADETTAHKTEEENSDSDSD

SEQ ID NO: 17430 - protein, 96 aa, Homo sapiens
  Payload ID: 3504
  Gene Symbol: CMTM3
  Gene Name: CKLF-like MARVEL transmembrane domain containing 3
  ENSP ID: ENSP00000457923
MQLNDKWQGLCWPMMDFLRCVTAALIYFAISITAIAKYSDGASKAAGVFGFFATIVFATDFYLIFNDVAKFLKQGDSADETTAHKTEEENSDSDSD

SEQ ID NO: 17431 - protein, 96 aa, Homo sapiens
  Payload ID: 3504
  Gene Symbol: CMTM3
  Gene Name: CKLF-like MARVEL transmembrane domain containing 3
  ENSP ID: ENSP00000460330
MQLNDKWQGLCWPMMDFLRCVTAALIYFAISITAIAKYSDGASKAAGVFGFFATIVFATDFYLIFNDVAKFLKQGDSADETTAHKTEARCWGHGDL

SEQ ID NO: 17432 - protein, 96 aa, Homo sapiens; identical to SEQ ID NO: 17430
  Payload ID: 3504
  Gene Symbol: CMTM3
  Gene Name: CKLF-like MARVEL transmembrane domain containing 3
  ENSP ID: ENSP00000461654

SEQ ID NO: 17433 - protein, 96 aa, Homo sapiens; identical to SEQ ID NO: 17430
  Payload ID: 3504
  Gene Symbol: CMTM3
  Gene Name: CKLF-like MARVEL transmembrane domain containing 3
  ENSP ID: ENSP00000461758

SEQ ID NO: 17434 - protein, 79 aa, Homo sapiens
  Payload ID: 3504
  Gene Symbol: CMTM3
  Gene Name: CKLF-like MARVEL transmembrane domain containing 3
  ENSP ID: ENSP00000462554
MQLNDKWQGLCWPMMDFLRCVTAALIYFAISITAIAKYSDGASKAAGGSVPDTRAVCPSRSEMGREAGAAASRSRESAL

SEQ ID NO: 17435 - protein, 165 aa, Homo sapiens
  Payload ID: 3504
  Gene Symbol: CMTM3
  Gene Name: CKLF-like MARVEL transmembrane domain containing 3
  ENSP ID: ENSP00000462613
MWPPDPDPDPDPEPAGGSRPGPAVPGLRALLPARAFLCSLKGRLLLAESGLSFITFICYVASSASAFLTAPLLEFLLALYFLFADAMQLNDKWQGLCWPMMDFLRCVTAALIYFAISITAIAKYSDGASKAAGGSVPDTRAVCPSRSEMGREAGAAASRSRESAL

SEQ ID NO: 17436 - protein, 234 aa, Homo sapiens
  Payload ID: 3505
  Gene Symbol: CMTM4
  Gene Name: CKLF-like MARVEL transmembrane domain containing 4
  Uniprot ID: Q8IZR5
  ENSP ID: ENSP00000333833
MRSGEELDGFEGEASSTSMISGASSPYQPTTEPVSQRRGLAGLRCDPDYLRGALGRLKVAQVILALIAFICIETIMACSPCEGLYFFEFVSCSAFVVTGVLLIMFSLNLHMRIPQINWNLTDLVNTGLSAFLFFIASIVLAALNHRAGAEIAAVIFGFLATAAYAVNTFLAVQKWRVSVRQQSTNDYIRARTESRDVDSRPEIQRLDTFSYSTNVTVRKKSPTNLLSLNHWQLA

SEQ ID NO: 17437 - protein, 208 aa, Homo sapiens
  Payload ID: 3505
  Gene Symbol: CMTM4
  Gene Name: CKLF-like MARVEL transmembrane domain containing 4
  Uniprot ID: Q8IZR5
  ENSP ID: ENSP00000377666
MRSGEELDGFEGEASSTSMISGASSPYQPTTEPVSQRRGLAGLRCDPDYLRGALGRLKVAQVILALIAFICIETIMACSPCEGLYFFEFVSCSAFVVTGVLLIMFSLNLHMRIPQINWNLTDLVNTGLSAFLFFIASIVLAALNHRAGAEIAAVIFGFLATAAYAVNTFLAVQKWRVSVRQQSTNDYIRARTESRDVDSRPEIQRLDT

SEQ ID NO: 17438 - protein, 179 aa, Homo sapiens
  Payload ID: 3505
  Gene Symbol: CMTM4
  Gene Name: CKLF-like MARVEL transmembrane domain containing 4
  Uniprot ID: Q8IZR5
  ENSP ID: ENSP00000456380
MRSGEELDGFEGEASSTSMISGASSPYQPTTEPILALIAFICIETIMACSPCEGLYFFEFVSCSAFVVTGVLLIMFSLNLHMRIPQINWNLTDLVNTGLSAFLFFIASIVLAALNHRAGAEIAAVIFGFLATAAYAVNTFLAVQKWRVSVRQQSTNDYIRARTESRDVDSRPEIQRLDT

SEQ ID NO: 17439 - protein, 140 aa, Homo sapiens
  Payload ID: 3505
  Gene Symbol: CMTM4
  Gene Name: CKLF-like MARVEL transmembrane domain containing 4
  ENSP ID: ENSP00000464316
FVVTGVLLIMFSLNLHMRIPQINWNLTDLVNTGLSAFLFFIASIVLAALNHRAGAEIAAVIFGFLATAAYAVNTFLAVQKWRVSVRQQSTNDYIRARTESRDVDSRPEIQRLDTFSYSTNVTVRKKSPTNLLSLNHWQLA

SEQ ID NO: 17440 - protein, 74 aa, Homo sapiens
  Payload ID: 3506
  Gene Symbol: CMTM5
  Gene Name: CKLF-like MARVEL transmembrane domain containing 5
  Uniprot ID: Q96DZ9
  ENSP ID: ENSP00000344160
MLSARDRRDRHPEEGVVAELQGFAVDKAFLTSHKGILLETELVFGIILVSIFAYDAFKIYRTEMAPGASQGDQQ

SEQ ID NO: 17441 - protein, 223 aa, Homo sapiens
  Payload ID: 3506
  Gene Symbol: CMTM5
  Gene Name: CKLF-like MARVEL transmembrane domain containing 5
  Uniprot ID: Q96DZ9
  ENSP ID: ENSP00000344819
MLSARDRRDRHPEEGVVAELQGFAVDKAFLTSHKGILLETELALTLIIFICFTASISAYMAAALLEFFITLAFLFLYATQYYQRFDRINWPCLLQGHGQSGGPHPLDLLSHSAKVQPQPWPGLTPPGWHTPAAVPWVPAPAPGFWSWLLWFICFHSLGSSDFLRCVSAIIIFLVVSFAAVTSRDGAAIAAFVFGIILVSIFAYDAFKIYRTEMAPGASQGDQQ

SEQ ID NO: 17442 - protein, 156 aa, Homo sapiens
  Payload ID: 3506
  Gene Symbol: CMTM5
  Gene Name: CKLF-like MARVEL transmembrane domain containing 5
  Uniprot ID: Q96DZ9
  ENSP ID: ENSP00000352270
MLSARDRRDRHPEEGVVAELQGFAVDKAFLTSHKGILLETELALTLIIFICFTASISAYMAAALLEFFITLAFLFLYATQYYQRFDRINWPCLDFLRCVSAIIIFLVVSFAAVTSRDGAAIAAFVFGIILVSIFAYDAFKIYRTEMAPGASQGDQQ

SEQ ID NO: 17443 - protein, 125 aa, Homo sapiens
  Payload ID: 3506
  Gene Symbol: CMTM5
  Gene Name: CKLF-like MARVEL transmembrane domain containing 5
  Uniprot ID: Q96DZ9
  ENSP ID: ENSP00000372259
MLSARDRRDRHPEEGVVAELQGFAVDKAFLTSHKGILLETELALTLIIFICFTASISAYMAAALLEFFITLAFLFLYATQYYQRFDRINWPCLVFGIILVSIFAYDAFKIYRTEMAPGASQGDQQ

SEQ ID NO: 17444 - protein, 105 aa, Homo sapiens
  Payload ID: 3506
  Gene Symbol: CMTM5
  Gene Name: CKLF-like MARVEL transmembrane domain containing 5
  Uniprot ID: Q96DZ9
  ENSP ID: ENSP00000380404
MLSARDRRDRHPEEGVVAELQGFAVDKAFLTSHKGILLETELDFLRCVSAIIIFLVVSFAAVTSRDGAAIAAFVFGIILVSIFAYDAFKIYRTEMAPGASQGDQQ

SEQ ID NO: 17445 - protein, 118 aa, Homo sapiens
  Payload ID: 3506
  Gene Symbol: CMTM5
  Gene Name: CKLF-like MARVEL transmembrane domain containing 5
  ENSP ID: ENSP00000451514
MLSARDRRDRHPEEGVVAELQGFAVDKAFLTSHKGILLETELYYQRFDRINWPCLDFLRCVSAIIIFLVVSFAAVTSRDGAAIAAFVFGIILVSIFAYDAFKIYRTEMAPGASQGDQQ

SEQ ID NO: 17446 - protein, 183 aa, Homo sapiens
  Payload ID: 3507
  Gene Symbol: CMTM6
  Gene Name: CKLF-like MARVEL transmembrane domain containing 6
  Uniprot ID: Q9NX76
  ENSP ID: ENSP00000205636
MENGAVYSPTTEEDPGPARGPRSGLAAYFFMGRLPLLRRVLKGLQLLLSLLAFICEEVVSQCTLCGGLYFFEFVSCSAFLLSLLILIVYCTPFYERVDTTKVKSSDFYITLGTGCVFLLASIIFVSTHDRTSAEIAAIVFGFIASFMFLLDFITMLYEKRQESQLRKPENTTRAEALTEPLNA

SEQ ID NO: 17447 - protein, 142 aa, Homo sapiens
  Payload ID: 3508
  Gene Symbol: CMTM7
  Gene Name: CKLF-like MARVEL transmembrane domain containing 7
  Uniprot ID: Q96FZ5
  ENSP ID: ENSP00000283621
MSHGAGLVRTTCSSGSALGPGAGAAQPSASPLEGLLDLSYPRTHAALLKVAQMVTLLIAFICVRSSLWTNYSAYSYFEVVTICDLIMILAFYLVHLFRFYRVLTCISWPLSIFGFMATFLCMASIWLSYKISCVTQSTDAAV

SEQ ID NO: 17448 - protein, 175 aa, Homo sapiens
  Payload ID: 3508
  Gene Symbol: CMTM7
  Gene Name: CKLF-like MARVEL transmembrane domain containing 7
  Uniprot ID: Q96FZ5
  ENSP ID: ENSP00000335605
MSHGAGLVRTTCSSGSALGPGAGAAQPSASPLEGLLDLSYPRTHAALLKVAQMVTLLIAFICVRSSLWTNYSAYSYFEVVTICDLIMILAFYLVHLFRFYRVLTCISWPLSELLHYLIGTLLLLIASIVAASKSYNQSGLVAGAIFGFMATFLCMASIWLSYKISCVTQSTDAAV

SEQ ID NO: 17449 - protein, 151 aa, Homo sapiens
  Payload ID: 3508
  Gene Symbol: CMTM7
  Gene Name: CKLF-like MARVEL transmembrane domain containing 7
  ENSP ID: ENSP00000414480
MSHGAGLVRTTCSSGSALGPGAGAAQPSASPLEGLLDLSYPRTHAALLKVAQMVTLLIAFICVRSSLWTNYSAYSYFEVVTICDLIMILAFYLVHLFRFYRVLTCISWPLSELLHYLIGTLLLLIASIVAASKSYNQSGLVAGADNQSPLA

SEQ ID NO: 17450 - protein, 163 aa, Homo sapiens
  Payload ID: 3508
  Gene Symbol: CMTM7
  Gene Name: CKLF-like MARVEL transmembrane domain containing 7
  ENSP ID: ENSP00000440333
AALLKVAQMVTLLIAFICVRSSLWTNYSAYSYFEVVTICDLIMILAFYLVHLFRFYRVLTCISWPLSMQPSDEATTPRPLRSFAERRTCTPGEASGPVFLCQSPVRLVGTRKGLHPLPALPGSQLPELLSQPETLPPAFRGEHPSHSGKGKQPPGKCFLPSCF

SEQ ID NO: 17451 - protein, 44 aa, Homo sapiens
  Payload ID: 3508
  Gene Symbol: CMTM7
  Gene Name: CKLF-like MARVEL transmembrane domain containing 7
  ENSP ID: ENSP00000445027
  MOD_RES (1)..(1): Any amino acid
XKSYNQSGLVAGAIFGFMATFLCMASIWLSYKISCVTQSTDAAV

SEQ ID NO: 17452 - protein, 173 aa, Homo sapiens
  Payload ID: 3509
  Gene Symbol: CMTM8
  Gene Name: CKLF-like MARVEL transmembrane domain containing 8
  Uniprot ID: Q8IZV2
  ENSP ID: ENSP00000307741
MEEPQRARSHTVTTTASSFAENFSTSSSSFAYDREFLRTLPGFLIVAEIVLGLLVWTLIAGTEYFRVPAFGWVMFVAVFYWVLTVFFLIIYITMTYTRIPQVPWTTVGLCFNGSAFVLYLSAAVVDASSVSPERDSHNFNSWAASSFFAFLVTICYAGNTYFSFIAWRSRTIQ

SEQ ID NO: 17453 - protein, 115 aa, Homo sapiens
  Payload ID: 3509
  Gene Symbol: CMTM8
  Gene Name: CKLF-like MARVEL transmembrane domain containing 8
  Uniprot ID: Q8IZV2
  ENSP ID: ENSP00000412934
MEEPQRARSHTVTTTASSFAENFSTSSSSFAYDREFLRTLPGFLIVAEIGLCFNGSAFVLYLSAAVVDASSVSPERDSHNFNSWAASSFFAFLVTICYAGNTYFSFIAWRSRTIQ

SEQ ID NO: 17454 - protein, 120 aa, Homo sapiens
  Payload ID: 3510
  Gene Symbol: CLRN1
  Gene Name: clarin 1
  Uniprot ID: P58418
  ENSP ID: ENSP00000295911
MQALQQQPVFPDLLKAIPVSIHVNVILFSAILIVLTMVGTAFFMYNAFGKPFETLHGPLGLYLLSFISGSCGCLVMILFASEVKIHHLSEKIANYKEGTYVYKTQSEKYTTSFWLTKGHS

SEQ ID NO: 17455 - protein, 232 aa, Homo sapiens
  Payload ID: 3510
  Gene Symbol: CLRN1
  Gene Name: clarin 1
  Uniprot ID: P58418
  ENSP ID: ENSP00000322280
MPSQQKKIIFCMAGVFSFACALGVVTALGTPLWIKATVLCKTGALLVNASGQELDKFMGEMQYGLFHGEGVRQCGLGARPFRFSFFPDLLKAIPVSIHVNVILFSAILIVLTMVGTAFFMYNAFGKPFETLHGPLGLYLLSFISGSCGCLVMILFASEVKIHHLSEKIANYKEGTYVYKTQSEKYTTSFWVIFFCFFVHFLNGLLIRLAGFQFPFAKSKDAETTNVAADLMY

SEQ ID NO: 17456 - protein, 245 aa, Homo sapiens
  Payload ID: 3510
  Gene Symbol: CLRN1
  Gene Name: clarin 1
  Uniprot ID: P58418
  ENSP ID: ENSP00000329158
MPSQQKKIIFCMAGVFSFACALGVVTALGTPLWIKATVLCKTGALLVNASGQELDKFMGEMQYGLFHGEGVRQCGLGARPFRFSFFPDLLKAIPVSIHVNVILFSAILIVLTMVGTAFFMYNAFGKPFETLHGPLGLYLLSFISVALWLPATRHQAQGSCGCLVMILFASEVKIHHLSEKIANYKEGTYVYKTQSEKYTTSFWVIFFCFFVHFLNGLLIRLAGFQFPFAKSKDAETTNVAADLMY

SEQ ID NO: 17457 - protein, 39 aa, Homo sapiens
  Payload ID: 3510
  Gene Symbol: CLRN1
  Gene Name: clarin 1
  ENSP ID: ENSP00000419244
MVGTAFFMYNAFGKPFETLHGPLGLYLLSFISGSCGCLV

SEQ ID NO: 17458 - protein, 115 aa, Homo sapiens
  Payload ID: 3510
  Gene Symbol: CLRN1
  Gene Name: clarin 1
  ENSP ID: ENSP00000419892
MQALQQQPVFPDLLKAIPVSIHVNVILFSAILIVLTMVGTAFFMYNAFGKPFETLHGPLGLYLLSFISGSCGCLVMILFASEVKIHHLSEKIANYKEGTYVYKTQSEKYTTSFWV

SEQ ID NO: 17459 - protein, 232 aa, Homo sapiens
  Payload ID: 3511
  Gene Symbol: CLRN2
  Gene Name: clarin 2
  Uniprot ID: A0PK11
  ENSP ID: ENSP00000424711
MPGWFKKAWYGLASLLSFSSFILIIVALVVPHWLSGKILCQTGVDLVNATDRELVKFIGDIYYGLFRGCKVRQCGLGGRQSQFTIFPHLVKELNAGLHVMILLLLFLALALALVSMGFAILNMIQVPYRAVSGPGGICLWNVLAGGVVALAIASFVAAVKFHDLTERIANFQEKLFQFVVVEEQYEESFWICVASASAHAANLVVVAISQIPLPEIKTKIEEATVTAEDILY

SEQ ID NO: 17460 - protein, 226 aa, Homo sapiens
  Payload ID: 3512
  Gene Symbol: CLRN3
  Gene Name: clarin 3
  Uniprot ID: Q8NCR9
  ENSP ID: ENSP00000357660
MPTTKKTLMFLSSFFTSLGSFIVICSILGTQAWITSTIAVRDSASNGSIFITYGLFRGESSEELSHGLAEPKKKFAVLEILNNSSQKTLHSVTILFLVLSLITSLLSSGFTFYNSISNPYQTFLGPTGVYTWNGLGASFVFVTMILFVANTQSNQLSEELFQMLYPATTSKGTTHSYGYSFWLILLVILLNIVTVTIIIFYQKARYQRKQEQRKPMEYAPRDGILF

SEQ ID NO: 17461 - protein, 1332 aa, Homo sapiens
  Payload ID: 3513
  Gene Symbol: CLSPN
  Gene Name: claspin
  Uniprot ID: Q9HAW4
  ENSP ID: ENSP00000251195
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRELEALKQRFWKHANPAAKPRAGQTVNVNVIVKDMGTDGKEELKADVVPVTLAPKKLDGASHTKPGEKLQVLKAKLQEAMKLRRFEERQKRQALFKLDNEDGFEEEEEEEEEMTDESEEDGEEKVEKEEKEEELEEEEEKEEEEEEEGNQETAEFLLSSEEIETKDEKEMDKENNDGSSEIGKAVGFLSVPKSLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQKIPEKDSDWLTWSGAPIPGFFRLSFDPHG

SEQ ID NO: 17462 - protein, 1339 aa, Homo sapiens
  Payload ID: 3513
  Gene Symbol: CLSPN
  Gene Name: claspin
  Uniprot ID: Q9HAW4
  ENSP ID: ENSP00000312995
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRELEALKQRFWKHANPAAKPRAGQTVNVNVIVKDMGTDGKEELKADVVPVTLAPKKLDGASHTKPGEKLQVLKAKLQEAMKLRRFEERQKRQALFKLDNEDGFEEEEEEEEEMTDESEEDGEEKVEKEEKEEELEEEEEKEEEEEEEGNQETAEFLLSSEEIETKDEKEMDKENNDGSSEIGKAVGFLSVPKSLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQVKKRGPSFMTSPSPKHLKTDDSTSGLTRSIFKYLES

SEQ ID NO: 17463 - protein, 1275 aa, Homo sapiens
  Payload ID: 3513
  Gene Symbol: CLSPN
  Gene Name: claspin
  Uniprot ID: Q9HAW4
  ENSP ID: ENSP00000362317
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRGEKLQVLKAKLQEAMKLRRFEERQKRQALFKLDNEDGFEEEEEEEEEMTDESEEDGEEKVEKEEKEEELEEEEEKEEEEEEEGNQETAEFLLSSEEIETKDEKEMDKENNDGSSEIGKAVGFLSVPKSLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQVKKRGPSFMTSPSPKHLKTDDSTSGLTRSIFKYLES

SEQ ID NO: 17464 - protein, 1286 aa, Homo sapiens
  Payload ID: 3513
  Gene Symbol: CLSPN
  Gene Name: claspin
  ENSP ID: ENSP00000428848
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRELEALKQRFWKHANPAAKPRAGQTVNVNVIVKDMGTDGKEELKADVVPVTLAPKKLDGASHTKPGEKLQVLKAKLQEAMKLRRFEERQKRQALFKLDNEDGFEEEEEEEEEMTDESEEDGEEKVEKEEKEEELEEEEEKEEEEEEEGNQEDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQVKKRGPSFMTSPSPKHLKTDDSTSGLTRSIFKYLES

SEQ ID NO: 17465 - protein, 1130 aa, Homo sapiens
  Payload ID: 3514
  Gene Symbol: CIITA
  Gene Name: class II, major histocompatibility complex, transactivator
  ENSP ID: ENSP00000316328
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPAEPPTVVTGSLLVGPVSDCSTLPCLPLPALFNQEPASGQMRLEKTDQIPMPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPEPVEQFYRSLQDTYGAEPAGPDGILVEVDLVQARLERSSSKSLERELATPDWAERQLAQGGLAEVLLAAKEHRRPRETRVIAVLGKAGQGKSYWAGAVSRAWACGRLPQYDFVFSVPCHCLNRPGDAYGLQDLLFSLGPQPLVAADEVFSHILKRPDRVLLILDGFEELEAQDGFLHSTCGPAPAEPCSLRGLLAGLFQKKLLRGCTLLLTARPRGRLVQSLSKADALFELSGFSMEQAQAYVMRYFESSGMTEHQDRALTLLRDRPLLLSHSHSPTLCRAVCQLSEALLELGEDAKLPSTLTGLYVGLLGRAALDSPPGALAELAKLAWELGRRHQSTLQEDQFPSADVRTWAMAKGLVQHPPRAAESELAFPSFLLQCFLGALWLALSGEIKDKELPQYLALTPRKKRPYDNWLEGVPRFLAGLIFQPPARCLGALLGPSAAASVDRKQKVLARYLKRLQPGTLRARQLLELLHCAHEAEEAGIWQHVVQELPGRLSFLGTRLTPPDAHVLGKALEAAGQDFSLDLRSTGICPSGLGSLVGLSCVTRFRAALSDTVALWESLQQHGETKLLQAAEEKFTIEPFKAKSLKDVEDLGKLVQTQRTRSSSEDTAGELPAVRDLKKLEFALGPVSGPQAFPKLVRILTAFSSLQHLDLDALSENKIGDEGVSQLSATFPQLKSLETLNLSQNNITDLGAYKLAEALPSLAASLLRLSLYNNCICDVGAESLARVLPDMVSLRVMDVQYNKFTAAGAQQLAASLRRCPHVETLAMWTPTIPFSVQEHLQQQDSRISLR

SEQ ID NO: 17466 - protein, 546 aa, Homo sapiens
  Payload ID: 3514
  Gene Symbol: CIITA
  Gene Name: class II, major histocompatibility complex, transactivator
  Uniprot ID: P33076
  ENSP ID: ENSP00000371257
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPVPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPGLAWSPCLGLRPSLHRAALSDTVALWESLQQHGETKLLQAAEEKFTIEPFKAKSLKDVEDLGKLVQTQRTRSSSEDTAGELPAVRDLKKLEFALGPVSGPQAFPKLVRILTAFSSLQHLDLDALSENKIGDEGVSQLSATFPQLKSLETLNLSQNNITDLGAYKLAEALPSLAASLLRLSLYNNCICDVGAESLARVLPDMVSLRVMDVQYNKFTAAGAQQLAASLRRCPHVETLAMWTPTIPFSVQEHLQQQDSRISLR

SEQ ID NO: 17467 - protein, 177 aa, Homo sapiens
  Payload ID: 3514
  Gene Symbol: CIITA
  Gene Name: class II, major histocompatibility complex, transactivator
  ENSP ID: ENSP00000459608
MELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPAEPPTVVTGSLLVGPVSDCSTLPCLPLPALFNQEPASGQMR

SEQ ID NO: 17468 - protein, 172 aa, Homo sapiens
  Payload ID: 3514
  Gene Symbol: CIITA
  Gene Name: class II, major histocompatibility complex, transactivator
  ENSP ID: ENSP00000459829
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPALRVEALGSCSA

SEQ ID NO: 17469 - protein, 884 aa, Homo sapiens
  Payload ID: 3514
  Gene Symbol: CIITA
  Gene Name: class II, major histocompatibility complex, transactivator
  ENSP ID: ENSP00000483487
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFIEHIGPDEVIGESMEMPAEVGQKSQKRPFPEELPADLKHWKPVPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPEPVEQFYRSLQDTYGAEPAGPDGILVEVDLVQARLERSSSKSLERELATPDWAERQLAQGGLAEVLLAAKEHRRPRETRVIAVLGKAGQGKSYWAGAVSRAWACGRLPQYDFVFSVPCHCLNRPGDAYGLQDLLFSLGPQPLVAADEVFSHILKRPDRVLLILDGFEELEAQDGFLHSTCGPAPAEPCSLRGLLAGLFQKKLLRGCTLLLTARPRGRLVQSLSKADALFELSGFSMEQAQAYVMRYFESSGMTEHQDRALTLLRDRPLLLSHSHSPTLCRAVCQLSEALLELGEDAKLPSTLTGLYVGLLGRAALDSPPGALAELAKLAWELGRRHQSTLQEDQFPSADVRTWAMAKGLVQHPPRAAESELAFPSFLLQCFLGALWLALSGEIKDKELPQYLALTPRKKRPYDNWLEGVPRFLAGLIFQPPARCLGALLGPSAAASVDRKQKVLARYLKRLQPGTLRARQLLELLHCAHEAEEAGIWQHVVQELPGRLSFLGTRLTPPDAHVLGKALEAAGQDFSLDLRSTGICPSGLGSLVGLSCVTRFRWGEGLGRDILVLGINCGLGAKPSALWGSFSMQSSRVGQNGFSPFLR

SEQ ID NO: 17470 - protein, 353 aa, Homo sapiens
  Payload ID: 3514
  Gene Symbol: CIITA
  Gene Name: class II, major histocompatibility complex, transactivator
  ENSP ID: ENSP00000484761
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPAEPPTVVTGSLLVGPVSDCSTLPCLPLPALFNQEPASGQMRLEKTDQIPMPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPGREVPRKTQLGSSLLFGT

SEQ ID NO: 17471 - protein, 1131 aa, Homo sapiens
  Payload ID: 3514
  Gene Symbol: CIITA
  Gene Name: class II, major histocompatibility complex, transactivator
  ENSP ID: ENSP00000485010
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFIEHIGPDEVIGESMEMPAEVGQKSQKRPFPEELPADLKHWKPAEPPTVVTGSLLVGPVSDCSTLPCLPLPALFNQEPASGQMRLEKTDQIPMPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPEPVEQFYRSLQDTYGAEPAGPDGILVEVDLVQARLERSSSKSLERELATPDWAERQLAQGGLAEVLLAAKEHRRPRETRVIAVLGKAGQGKSYWAGAVSRAWACGRLPQYDFVFSVPCHCLNRPGDAYGLQDLLFSLGPQPLVAADEVFSHILKRPDRVLLILDGFEELEAQDGFLHSTCGPAPAEPCSLRGLLAGLFQKKLLRGCTLLLTARPRGRLVQSLSKADALFELSGFSMEQAQAYVMRYFESSGMTEHQDRALTLLRDRPLLLSHSHSPTLCRAVCQLSEALLELGEDAKLPSTLTGLYVGLLGRAALDSPPGALAELAKLAWELGRRHQSTLQEDQFPSADVRTWAMAKGLVQHPPRAAESELAFPSFLLQCFLGALWLALSGEIKDKELPQYLALTPRKKRPYDNWLEGVPRFLAGLIFQPPARCLGALLGPSAAASVDRKQKVLARYLKRLQPGTLRARQLLELLHCAHEAEEAGIWQHVVQELPGRLSFLGTRLTPPDAHVLGKALEAAGQDFSLDLRSTGICPSGLGSLVGLSCVTRFRAALSDTVALWESLQQHGETKLLQAAEEKFTIEPFKAKSLKDVEDLGKLVQTQRTRSSSEDTAGELPAVRDLKKLEFALGPVSGPQAFPKLVRILTAFSSLQHLDLDALSENKIGDEGVSQLSATFPQLKSLETLNLSQNNITDLGAYKLAEALPSLAASLLRLSLYNNCICDVGAESLARVLPDMVSLRVMDVQYNKFTAAGAQQLAASLRRCPHVETLAMWTPTIPFSVQEHLQQQDSRISLR

SEQ ID NO: 17472 - protein, 586 aa, Homo sapiens
  Payload ID: 3515
  Gene Symbol: CLHC1
  Gene Name: clathrin heavy chain linker domain containing 1
  Uniprot ID: Q8NHS4
  ENSP ID: ENSP00000384869
MSVHQIRKHAVLPPIICRSDKEFLESVQRYIITETERLGCSEEGPADEYYIIYRNVFDKVIEHITAYKSILTSIKKEYDAFIETIKKDRRTTFCLHGKLKGLAAEPTALVYYRKRTIQLEAKMRIIESNSSKIQSQIDHIKQCRAEYDTKEVKYCTFSKDPSKPIPGMTLQESMNLDALTKYMKHLEDKYAEIKQAMLIKYVPAQRKADLDEEMIVLLKRRDVAENLNKKLQFCHQRLQIISQALSSWVKSDMSSPFQDFVEQIQKTKYLQGDQGIVEELMEDDPRRAKEAEIMLHYIERFNELISLGEYEKAACYAANSPRRILRNIGTMNTFKAVGKIRGKPLPLLLFFEALFITSHAFPCPVDAALTLEGIKCGLSEKRLDLVTNWVTQERLTFSEEAGDVICDYGEQDTYNKAKCLALAQIVYSECGLHKKAILCLCKQGQTHRVMEYIQQLKDFTTDDLLQLLMSCPQVELIQCLTKELNEKQPSLSFGLAILHLFSADMKKVGIKLLQEINKGGIDAVESLMINDSFCSIEKWQEVANICSQNGFDKLSNDITSILRSQAAVTEISEEDDAVNLMEHVFW

SEQ ID NO: 17473 - protein, 464 aa, Homo sapiens
  Payload ID: 3515
  Gene Symbol: CLHC1
  Gene Name: clathrin heavy chain linker domain containing 1
  Uniprot ID: Q8NHS4
  ENSP ID: ENSP00000385512
MRIIESNSSKIQSQIDHIKQCRAEYDTKEVKYCTFSKDPSKPIPGMTLQESMNLDALTKYMKHLEDKYAEIKQAMLIKYVPAQRKADLDEEMIVLLKRRDVAENLNKKLQFCHQRLQIISQALSSWVKSDMSSPFQDFVEQIQKTKYLQGDQGIVEELMEDDPRRAKEAEIMLHYIERFNELISLGEYEKAACYAANSPRRILRNIGTMNTFKAVGKIRGKPLPLLLFFEALFITSHAFPCPVDAALTLEGIKCGLSEKRLDLVTNWVTQERLTFSEEAGDVICDYGEQDTYNKAKCLALAQIVYSECGLHKKAILCLCKQGQTHRVMEYIQQLKDFTTDDLLQLLMSCPQVELIQCLTKELNEKQPSLSFGLAILHLFSADMKKVGIKLLQEINKGGIDAVESLMINDSFCSIEKWQEVANICSQNGFDKLSNDITSILRSQAAVTEISEEDDAVNLMEHVFW

SEQ ID NO: 17474 - protein, 46 aa, Homo sapiens
  Payload ID: 3515
  Gene Symbol: CLHC1
  Gene Name: clathrin heavy chain linker domain containing 1
  ENSP ID: ENSP00000385598
MSVHQIRKHAVLPPIICRSDKEFLESVQRYIITETERLGCSEEGPA

SEQ ID NO: 17475 - protein, 586 aa, Homo sapiens; identical to SEQ ID NO: 17472
  Payload ID: 3515
  Gene Symbol: CLHC1
  Gene Name: clathrin heavy chain linker domain containing 1
  Uniprot ID: Q8NHS4
  ENSP ID: ENSP00000385778

SEQ ID NO: 17476 - protein, 49 aa, Homo sapiens
  Payload ID: 3515
  Gene Symbol: CLHC1
  Gene Name: clathrin heavy chain linker domain containing 1
  ENSP ID: ENSP00000399821
LNKKLQFCHQRLQIISQALSSWVKSDMSSPFQDFVEQIQKTKYLQGLMS

SEQ ID NO: 17477 - protein, 17 aa, Homo sapiens
  Payload ID: 3515
  Gene Symbol: CLHC1
  Gene Name: clathrin heavy chain linker domain containing 1
  ENSP ID: ENSP00000400116
MSVHQIRKHAVLPPIIC

SEQ ID NO: 17478 - protein, 92 aa, Homo sapiens
  Payload ID: 3515
  Gene Symbol: CLHC1
  Gene Name: clathrin heavy chain linker domain containing 1
  ENSP ID: ENSP00000401526
MSVHQIRKHAVLPPIICRSDKEFLESVQRYIITETERLGCSEEGPADEYYIIYRNVFDKLLEKLEESLFHYSYFLRPSLSQVMLFHVLLMQL

SEQ ID NO: 17479 - protein, 80 aa, Homo sapiens
  Payload ID: 3515
  Gene Symbol: CLHC1
  Gene Name: clathrin heavy chain linker domain containing 1
  ENSP ID: ENSP00000407575
MSVHQIRKHAVLPPIICRSDKEFLESVQRYIITETERLGCSEEGPADEYYIIYRNVFDKVIEHITAYKSILTSIKKEYDA

SEQ ID NO: 17480 - protein, 625 aa, Homo sapiens
  Payload ID: 3516
  Gene Symbol: CLINT1
  Gene Name: clathrin interactor 1
  Uniprot ID: Q14677
  ENSP ID: ENSP00000388340
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANPSKTIDLGAAAHYTGDKASPDQNASTHTPQSSVKTSVPSSKSSGDLVDLFDGTSQSTGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQNTDMVQKSVSKTLPSTWSDPSVNISLDNLLPGMQPSKPQQPSLNTMIQQQNMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 17481 - protein, 625 aa, Homo sapiens
  Payload ID: 3516
  Gene Symbol: CLINT1
  Gene Name: clathrin interactor 1
  Uniprot ID: Q14677
  ENSP ID: ENSP00000429345
MNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANPSKTIDLGAAAHYTGDKASPDQNASTHTPQSSVKTSVPSSKSSGDLVDLFDGTSQSTGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQPLQNVSTVLQKPNPLYNQNTDMVQKSVSKTLPSTWSDPSVNISLDNLLPGMQPSKPQQPSLNTMIQQQNMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 17482 - protein, 643 aa, Homo sapiens
  Payload ID: 3516
  Gene Symbol: CLINT1
  Gene Name: clathrin interactor 1
  Uniprot ID: Q14677
  ENSP ID: ENSP00000429824
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANPSKTIDLGAAAHYTGDKASPDQNASTHTPQSSVKTSVPSSKSSGDLVDLFDGTSQSTGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQPLQNVSTVLQKPNPLYNQNTDMVQKSVSKTLPSTWSDPSVNISLDNLLPGMQPSKPQQPSLNTMIQQQNMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 17483 - protein, 55 aa, Homo sapiens
  Payload ID: 3516
  Gene Symbol: CLINT1
  Gene Name: clathrin interactor 1
  ENSP ID: ENSP00000431858
  MOD_RES (1)..(1): Any amino acid
XPAASNSSDLFDLMGSSQATMTSSQSMNFSMMSTNTVGLGLPMSRSQILVFGVLG

SEQ ID NO: 17484 - protein, 133 aa, Homo sapiens
  Payload ID: 3516
  Gene Symbol: CLINT1
  Gene Name: clathrin interactor 1
  ENSP ID: ENSP00000433013
  MOD_RES (1)..(1): Any amino acid
XIDLGAAAHYTGDKASPDQNASTHTPQSSVKTSVPSSKSSGDLVDLFDGTSQSTVTATSGNGDFGDWSAFNQAPSGPVASSGEFFGSASQPAVELVSGSQSALGPPPAASNSSDLFDLMGSSQATMTSSQSMN

SEQ ID NO: 17485 - protein, 625 aa, Homo sapiens; identical to SEQ ID NO: 17481
  Payload ID: 3516
  Gene Symbol: CLINT1
  Gene Name: clathrin interactor 1
  Uniprot ID: Q14677
  ENSP ID: ENSP00000433419

SEQ ID NO: 17486 - protein, 66 aa, Homo sapiens
  Payload ID: 3516
  Gene Symbol: CLINT1
  Gene Name: clathrin interactor 1
  ENSP ID: ENSP00000434334
  MOD_RES (1)..(1): Any amino acid
XLPMSRSQNTDMVQKSVSKTLPSTWSDPSVNISLDNLLPGMQPSKPQQPSLNTMIQQQILLSVFVW

SEQ ID NO: 17487 - protein, 1675 aa, Homo sapiens
  Payload ID: 3517
  Gene Symbol: CLTC
  Gene Name: clathrin, heavy chain (Hc)
  Uniprot ID: Q00610
  ENSP ID: ENSP00000269122
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 17488 - protein, 1639 aa, Homo sapiens
  Payload ID: 3517
  Gene Symbol: CLTC
  Gene Name: clathrin, heavy chain (Hc)
  Uniprot ID: Q00610
  ENSP ID: ENSP00000376763
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGNLSL

SEQ ID NO: 17489 - protein, 131 aa, Homo sapiens
  Payload ID: 3517
  Gene Symbol: CLTC
  Gene Name: clathrin, heavy chain (Hc)
  ENSP ID: ENSP00000461977
  MOD_RES (1)..(1): Any amino acid
XEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDAIKEKVKVDSLTSLSLED

SEQ ID NO: 17490 - protein, 612 aa, Homo sapiens
  Payload ID: 3517
  Gene Symbol: CLTC
  Gene Name: clathrin, heavy chain (Hc)
  ENSP ID: ENSP00000462252
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 17491 - protein, 122 aa, Homo sapiens
  Payload ID: 3517
  Gene Symbol: CLTC
  Gene Name: clathrin, heavy chain (Hc)
  ENSP ID: ENSP00000462592
MAQILPIRFQEHLQLQNLGINPANIGFSTLTMESDKFICIREKVGEQAQVVIIDMNDPSNPIRRPISADSAIMNPASKVIALKGIKESGKTLQIFNIEMKSKMKAHTMTDDVTFWKWISLNT

SEQ ID NO: 17492 - protein, 24 aa, Homo sapiens
  Payload ID: 3517
  Gene Symbol: CLTC
  Gene Name: clathrin, heavy chain (Hc)
  ENSP ID: ENSP00000463068
  MOD_RES (1)..(1): Any amino acid
XTIFVTAPHEATAGIIGVNRKGQN

SEQ ID NO: 17493 - protein, 97 aa, Homo sapiens
  Payload ID: 3517
  Gene Symbol: CLTC
  Gene Name: clathrin, heavy chain (Hc)
  ENSP ID: ENSP00000463336
MAQILPIRFQEHLQLQNLGINPANIGFSTLTMESDKFICIREKVGEQAQVVIIDMNDPSNPIRRPISADSAIMNPASKVIALKAKSCGGSYAAIFCR

SEQ ID NO: 17494 - protein, 222 aa, Homo sapiens
  Payload ID: 3517
  Gene Symbol: CLTC
  Gene Name: clathrin, heavy chain (Hc)
  ENSP ID: ENSP00000465200
  MOD_RES (1)..(1): Any amino acid
XRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDAIKEKVDKLDASESLRKEEEQATETQPIVYGQPQLMLTAGPSVAVPPQAPFGYGYTAPPYGQ

SEQ ID NO: 17495 - protein, 1679 aa, Homo sapiens
  Payload ID: 3517
  Gene Symbol: CLTC
  Gene Name: clathrin, heavy chain (Hc)
  ENSP ID: ENSP00000479606
MAQILPIRFQEHLQLQNLGINPANIGFSTLTMESDKFICIREKVGEQAQVVIIDMNDPSNPIRRPISADSAIMNPASKVIALKGIKESGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 17496 - protein, 43 aa, Homo sapiens
  Payload ID: 3518
  Gene Symbol: CLTCL1
  Gene Name: clathrin, heavy chain-like 1
  ENSP ID: ENSP00000396140
LCEKAGLLQQALEHYTDLYDIKRAVVHTHLLNPEASSTSWAQS

SEQ ID NO: 17497 - protein, 1640 aa, Homo sapiens
  Payload ID: 3518
  Gene Symbol: CLTCL1
  Gene Name: clathrin, heavy chain-like 1
  Uniprot ID: P53675
  ENSP ID: ENSP00000441158
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQGLRASIDAYDNFDNISLAQQLEKHQLMEFRCIAAYLYKGNNWWAQSVELCKKDHLYKDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 17498 - protein, 169 aa, Homo sapiens
  Payload ID: 3518
  Gene Symbol: CLTCL1
  Gene Name: clathrin, heavy chain-like 1
  ENSP ID: ENSP00000443264
MAQILPVRFQEHFQLQNLGINPANIGFSTLTMESDKFICIREKVGEQAQVTIIDMSDPMAPIRRPISAESAIMNPASKVIALKGAPGFCSPASNSQSPGSSLCPAGKTLQIFNIEMKSKMKAHTMAEEVIFWKWVSVNTVALVTETAVYHWSMEGDSQPMKMFDRHTSL

SEQ ID NO: 17499 - protein, 67 aa, Homo sapiens
  Payload ID: 3518
  Gene Symbol: CLTCL1
  Gene Name: clathrin, heavy chain-like 1
  ENSP ID: ENSP00000443582
GLRASIDAYDNFDNISLAQQLEKHQLMEFRCIAAYLYKGNNWWAQSVELCKKDHLYKEQCGSGGSDR

SEQ ID NO: 17500 - protein, 369 aa, Homo sapiens
  Payload ID: 3518
  Gene Symbol: CLTCL1
  Gene Name: clathrin, heavy chain-like 1
  ENSP ID: ENSP00000479237
MGVGDRCFSVMQIKIMRSKPHEEVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 17501 - protein, 1260 aa, Homo sapiens
  Payload ID: 3518
  Gene Symbol: CLTCL1
  Gene Name: clathrin, heavy chain-like 1
  ENSP ID: ENSP00000480709
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGVLCLHGWTRVPLRTAVWSSHRHSCR

SEQ ID NO: 17502 - protein, 463 aa, Homo sapiens
  Payload ID: 3518
  Gene Symbol: CLTCL1
  Gene Name: clathrin, heavy chain-like 1
  ENSP ID: ENSP00000481031
MGVGDRCFSVMQIKIMRSKPHEEVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQGLRASIDAYDNFDNISLAQQLEKHQLMEFRCIAAYLYKGNNWWAQSVELCKKDHLYKDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 17503 - protein, 1583 aa, Homo sapiens
  Payload ID: 3518
  Gene Symbol: CLTCL1
  Gene Name: clathrin, heavy chain-like 1
  Uniprot ID: P53675
  ENSP ID: ENSP00000485020
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 17504 - protein, 218 aa, Homo sapiens
  Payload ID: 3519
  Gene Symbol: CLTA
  Gene Name: clathrin, light chain A
  Uniprot ID: P09496
  ENSP ID: ENSP00000242284
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWKEKAIKELEEWYARQDEQLQKTKANNRAAEEAFVNDIDESSPGTEWERVARLCDFNPKSSKQAKDVSRMRSVLISLKQAPLVH

SEQ ID NO: 17505 - protein, 248 aa, Homo sapiens
  Payload ID: 3519
  Gene Symbol: CLTA
  Gene Name: clathrin, light chain A
  Uniprot ID: P09496
  ENSP ID: ENSP00000242285
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWKEKAIKELEEWYARQDEQLQKTKANNRVADEAFYKQPFADVIGYVTNINHPCYSLEQAAEEAFVNDIDESSPGTEWERVARLCDFNPKSSKQAKDVSRMRSVLISLKQAPLVH

SEQ ID NO: 17506 - protein, 236 aa, Homo sapiens
  Payload ID: 3519
  Gene Symbol: CLTA
  Gene Name: clathrin, light chain A
  Uniprot ID: P09496
  ENSP ID: ENSP00000379848
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWKEKAIKELEEWYARQDEQLQKTKANNRVADEAFYKQPFADVIGYVAAEEAFVNDIDESSPGTEWERVARLCDFNPKSSKQAKDVSRMRSVLISLKQAPLVH

SEQ ID NO: 17507 - protein, 248 aa, Homo sapiens; identical to SEQ ID NO: 17505
  Payload ID: 3519
  Gene Symbol: CLTA
  Gene Name: clathrin, light chain A
  Uniprot ID: P09496
  ENSP ID: ENSP00000401019

SEQ ID NO: 17508 - protein, 196 aa, Homo sapiens
  Payload ID: 3519
  Gene Symbol: CLTA
  Gene Name: clathrin, light chain A
  ENSP ID: ENSP00000417698
MAELDPFGAPAGAPGGPALGNGVAGAGEEDPAAAFLAQQESEIAGIENDEAFAILDGGAPGPQPHGEPPGGPDANSRKQEAEWKEKAIKELEEWYARQDEQLQKTKANNRVADEAFYKQPFADVIGYVTNINHPCYSLEQAAEEAFVNDIDESSPGTEWERVARLCDFNPKSSKQAKDVSRMRSVLISLKQAPLVH

SEQ ID NO: 17509 - protein, 260 aa, Homo sapiens
  Payload ID: 3519
  Gene Symbol: CLTA
  Gene Name: clathrin, light chain A
  ENSP ID: ENSP00000419158
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWKEKAIKELEEWYARQDEQLQKTKANNRVSLLPRLECNGVISAHCNLCLPGSSNSPASASRGAGITDMCHRARLIFVFLVEMGFHHVGQAGLKILTSNDLPASARARITGRWKGVKDVAMYVPSLP

SEQ ID NO: 17510 - protein, 230 aa, Homo sapiens
  Payload ID: 3519
  Gene Symbol: CLTA
  Gene Name: clathrin, light chain A
  Uniprot ID: P09496
  ENSP ID: ENSP00000419746
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWKEKAIKELEEWYARQDEQLQKTKANNSTNINHPCYSLEQAAEEAFVNDIDESSPGTEWERVARLCDFNPKSSKQAKDVSRMRSVLISLKQAPLVH

SEQ ID NO: 17511 - protein, 166 aa, Homo sapiens
  Payload ID: 3519
  Gene Symbol: CLTA
  Gene Name: clathrin, light chain A
  Uniprot ID: P09496
  ENSP ID: ENSP00000437508
MAELDPFGAPAGAPGGPALGNGVAGAGEEDPAAAFLAQQESEIAGIENDEAFAILDGGAPGPQPHGEPPGGPDANSRKQEAEWKEKAIKELEEWYARQDEQLQKTKANNRAAEEAFVNDIDESSPGTEWERVARLCDFNPKSSKQAKDVSRMRSVLISLKQAPLVH

SEQ ID NO: 17512 - protein, 230 aa, Homo sapiens; identical to SEQ ID NO: 17510
  Payload ID: 3519
  Gene Symbol: CLTA
  Gene Name: clathrin, light chain A
  Uniprot ID: P09496
  ENSP ID: ENSP00000442869

SEQ ID NO: 17513 - protein, 64 aa, Homo sapiens
  Payload ID: 3519
  Gene Symbol: CLTA
  Gene Name: clathrin, light chain A
  ENSP ID: ENSP00000474266
AQQESEIAGIENDEAFAILDGGAPGPQPHGEPPGGPDAVDGVMNGEYYQMPILGSKKQSGKKRQ

SEQ ID NO: 17514 - protein, 229 aa, Homo sapiens
  Payload ID: 3520
  Gene Symbol: CLTB
  Gene Name: clathrin, light chain B
  Uniprot ID: P09497
  ENSP ID: ENSP00000309415
MADDFGFFSSSESGAPEAAEEDPAAAFLAQQESEIAGIENDEGFGAPAGSHAAPAQPGPTSGAGSEDMGTTVNGDVFQEANGPADGYAAIAQADRLTQEPESIRKWREEQRKRLQELDAASKVTEQEWREKAKKDLEEWNQRQSEQVEKNKINNRIADKAFYQQPDADIIGYVASEEAFVKESKEETPGTEWEKVAQLCDFNPKSSKQCKDVSRLRSVLMSLKQTPLSR

SEQ ID NO: 17515 - protein, 211 aa, Homo sapiens
  Payload ID: 3520
  Gene Symbol: CLTB
  Gene Name: clathrin, light chain B
  Uniprot ID: P09497
  ENSP ID: ENSP00000310812
MADDFGFFSSSESGAPEAAEEDPAAAFLAQQESEIAGIENDEGFGAPAGSHAAPAQPGPTSGAGSEDMGTTVNGDVFQEANGPADGYAAIAQADRLTQEPESIRKWREEQRKRLQELDAASKVTEQEWREKAKKDLEEWNQRQSEQVEKNKINNRASEEAFVKESKEETPGTEWEKVAQLCDFNPKSSKQCKDVSRLRSVLMSLKQTPLSR

SEQ ID NO: 17516 - protein, 134 aa, Homo sapiens
  Payload ID: 3520
  Gene Symbol: CLTB
  Gene Name: clathrin, light chain B
  ENSP ID: ENSP00000422978
MADDFGFFSSSESGAPEAAEEDPAAAFLAQQESEIAGIENDEGFGAPAGSHAAPAQPGPTSGAGSEDMGTTVNGDVFQPVHHQRVQLQTQLPIQPKDEPAHNYSSSIWHSQGQGQKGPAGLRLPTSAQILSPFP

SEQ ID NO: 17517 - protein, 81 aa, Homo sapiens
  Payload ID: 3520
  Gene Symbol: CLTB
  Gene Name: clathrin, light chain B
  ENSP ID: ENSP00000424739
IAGIENDEGFGAPAGSHAAPAQPGPTSGAGSEDMGTTVNGDVFQEANGPADGYAAIAQADRLTQEPESIRKWREEQRKRLS

SEQ ID NO: 17518 - protein, 125 aa, Homo sapiens
  Payload ID: 3520
  Gene Symbol: CLTB
  Gene Name: clathrin, light chain B
  ENSP ID: ENSP00000427229
MADDFGFFSSSESGAPEAAEEDPAAAFLAQQESEIAGIENDEGFGAPAGSHAAPAQPGPTSGAGSEDMGTTVNGDVFQEAFVKESKEETPGTEWEKVAQLCDFNPKSSKQCKDVSRLRSVLMSLK

SEQ ID NO: 17519 - protein, 211 aa, Homo sapiens
  Payload ID: 3521
  Gene Symbol: CLDN1
  Gene Name: claudin 1
  Uniprot ID: O95832
  ENSP ID: ENSP00000295522
MANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVATVGMKCMKCLEDDEVQKMRMAVIGGAIFLLAGLAILVATAWYGNRIVQEFYDPMTPVNARYEFGQALFTGWAAASLCLLGGALLCCSCPRKTTSYPTPRPYPKPAPSSGKDYV

SEQ ID NO: 17520 - protein, 228 aa, Homo sapiens
  Payload ID: 3522
  Gene Symbol: CLDN10
  Gene Name: claudin 10
  Uniprot ID: P78369
  ENSP ID: ENSP00000299339
MASTASEIIAFMVSISGWVLVSSTLPTDYWKVSTIDGTVITTATYWANLWKACVTDSTGVSNCKDFPSMLALDGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 17521 - protein, 73 aa, Homo sapiens
  Payload ID: 3522
  Gene Symbol: CLDN10
  Gene Name: claudin 10
  ENSP ID: ENSP00000366051
MIAAVSLGFFGSIFALFGMKCTKVGGSDKAKAKIACLAGIVFILSGLCSMTGCSLYANKITTEFFDPLFVEQK

SEQ ID NO: 17522 - protein, 226 aa, Homo sapiens
  Payload ID: 3522
  Gene Symbol: CLDN10
  Gene Name: claudin 10
  Uniprot ID: P78369
  ENSP ID: ENSP00000366069
MSRAQIWALVSGVGGFGALVAATTSNEWKVTTRASSVITATWVYQGLWMNCAGNALGSFHCRPHFTIFKVAGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 17523 - protein, 207 aa, Homo sapiens
  Payload ID: 3523
  Gene Symbol: CLDN11
  Gene Name: claudin 11
  Uniprot ID: O75508
  ENSP ID: ENSP00000064724
MVATCLQVVGFVTSFVGWIGVIVTTSTNDWVVTCGYTIPTCRKLDELGSKGLWADCVMATGLYHCKPLVDILILPGYVQACRALMIAASVLGLPAILLLLTVLPCIRMGQEPGVAKYRRAQLAGVLLILLALCALVATIWFPVCAHRETTIVSFGYSLYAGWIGAVLCLVGGCVILCCAGDAQAFGENRFYYTAGSSSPTHAKSAHV

SEQ ID NO: 17524 - protein, 165 aa, Homo sapiens
  Payload ID: 3523
  Gene Symbol: CLDN11
  Gene Name: claudin 11
  ENSP ID: ENSP00000417434
MVATCLQVVGFVTSFVGWIGVIVTTSTNDWVVTCGYTIPTCRKLDELGSKGLWADCVMATGLYHCKPLVDILILPGYVQACRALMIAASVLGLPAILLLLTVLPCIRMGQEPGVAKYRRAQLAGVLLILLGCQLLWAKTESSLHSQHLVQFKQKYLEDFSYLQGD

SEQ ID NO: 17525 - protein, 244 aa, Homo sapiens
  Payload ID: 3524
  Gene Symbol: CLDN12
  Gene Name: claudin 12
  Uniprot ID: P56749
  ENSP ID: ENSP00000287916
MGCRDVHAATVLSFLCGIASVAGLFAGTLLPNWRKLRLITFNRNEKNLTVYTGLWVKCARYDGSSDCLMYDTTWYSSVDQLDLRVLQFALPLSMLIAMGALLLCLIGMCNTAFRSSVPNIKLAKCLVNSAGCHLVAGLLFFLAGTVSLSPSIWVIFYNIHLNKKFEPVFSFDYAVYVTIASAGGLFMTSLILFIWYCTCKSLPSPFWQPLYSHPPSMHTYSQPYSARSRLSAIEIDIPVVSHTT

SEQ ID NO: 17526 - protein, 187 aa, Homo sapiens
  Payload ID: 3524
  Gene Symbol: CLDN12
  Gene Name: claudin 12
  ENSP ID: ENSP00000378102
MGCRDVHAATVLSFLCGIASVAGLFAGTLLPNWRKLRLITFNRNEKNLTVYTGLWVKCARYDGSSDCLMYDTTWYSSVDQLDLRVLQFALPLSMLIAMGALLLCLIGMCNTAFRSSVPNIKLAKCLVNSAGCHLVAGLLFFLAGTVSLSPSIWVIFYNIHLNKKFEPVFSFDYAVYVTIASAGGLFM

SEQ ID NO: 17527 - protein, 244 aa, Homo sapiens; identical to SEQ ID NO: 17525
  Payload ID: 3524
  Gene Symbol: CLDN12
  Gene Name: claudin 12
  Uniprot ID: P56749
  ENSP ID: ENSP00000378103

SEQ ID NO: 17528 - protein, 126 aa, Homo sapiens
  Payload ID: 3524
  Gene Symbol: CLDN12
  Gene Name: claudin 12
  ENSP ID: ENSP00000391062
MGCRDVHAATVLSFLCGIASVAGLFAGTLLPNWRKLRLITFNRNEKNLTVYTGLWVKCARYDGSSDCLMYDTTWYSSVDQLDLRVLQFALPLSMLIAMGALLLCLIGMCNTAFRSSVPNIKLAKCL

SEQ ID NO: 17529 - protein, 175 aa, Homo sapiens
  Payload ID: 3524
  Gene Symbol: CLDN12
  Gene Name: claudin 12
  ENSP ID: ENSP00000411399
MGCRDVHAATVLSFLCGIASVAGLFAGTLLPNWRKLRLITFNRNEKNLTVYTGLWVKCARYDGSSDCLMYDTTWYSSVDQLDLRVLQFALPLSMLIAMGALLLCLIGMCNTAFRSSVPNIKLAKCLVNSAGCHLVAGLLFFLAGTVSLSPSIWVIFYNIHLNKKFEPVFSFDYAV

SEQ ID NO: 17530 - protein, 244 aa, Homo sapiens; identical to SEQ ID NO: 17525
  Payload ID: 3524
  Gene Symbol: CLDN12
  Gene Name: claudin 12
  Uniprot ID: P56749
  ENSP ID: ENSP00000419053

SEQ ID NO: 17531 - protein, 239 aa, Homo sapiens
  Payload ID: 3525
  Gene Symbol: CLDN14
  Gene Name: claudin 14
  Uniprot ID: O95500
  ENSP ID: ENSP00000339292
MASTAVQLLGFLLSFLGMVGTLITTILPHWRRTAHVGTNILTAVSYLKGLWMECVWHSTGIYQCQIYRSLLALPQDLQAARALMVISCLLSGIACACAVIGMKCTRCAKGTPAKTTFAILGGTLFILAGLLCMVAVSWTTNDVVQNFYNPLLPSGMKFEIGQALYLGFISSSLSLIGGTLLCLSCQDEAPYRPYQAPPRATTTTANTAPAYQPPAAYKDNRAPSVTSATHSGYRLNDYV

SEQ ID NO: 17532 - protein, 239 aa, Homo sapiens; identical to SEQ ID NO: 17531
  Payload ID: 3525
  Gene Symbol: CLDN14
  Gene Name: claudin 14
  Uniprot ID: O95500
  ENSP ID: ENSP00000382087

SEQ ID NO: 17533 - protein, 239 aa, Homo sapiens; identical to SEQ ID NO: 17531
  Payload ID: 3525
  Gene Symbol: CLDN14
  Gene Name: claudin 14
  Uniprot ID: O95500
  ENSP ID: ENSP00000382088

SEQ ID NO: 17534 - protein, 239 aa, Homo sapiens; identical to SEQ ID NO: 17531
  Payload ID: 3525
  Gene Symbol: CLDN14
  Gene Name: claudin 14
  Uniprot ID: O95500
  ENSP ID: ENSP00000382090

SEQ ID NO: 17535 - protein, 239 aa, Homo sapiens; identical to SEQ ID NO: 17531
  Payload ID: 3525
  Gene Symbol: CLDN14
  Gene Name: claudin 14
  Uniprot ID: O95500
  ENSP ID: ENSP00000382092

SEQ ID NO: 17536 - protein, 228 aa, Homo sapiens
  Payload ID: 3526
  Gene Symbol: CLDN15
  Gene Name: claudin 15
  Uniprot ID: P56746
  ENSP ID: ENSP00000308870
MSMAVETFGFFMATVGLLMLGVTLPNSYWRVSTVHGNVITTNTIFENLWFSCATDSLGVYNCWEFPSMLALSGYIQACRALMITAILLGFLGLLLGIAGLRCTNIGGLELSRKAKLAATAGALHILAGICGMVAISWYAFNITRDFFDPLYPGTKYELGPALYLGWSASLISILGGLCLCSACCCGSDEDPAASARRPYQAPVSVMPVATSDQEGDSSFGKYGRNAYV

SEQ ID NO: 17537 - protein, 228 aa, Homo sapiens; identical to SEQ ID NO: 17536
  Payload ID: 3526
  Gene Symbol: CLDN15
  Gene Name: claudin 15
  Uniprot ID: P56746
  ENSP ID: ENSP00000385300

SEQ ID NO: 17538 - protein, 170 aa, Homo sapiens
  Payload ID: 3526
  Gene Symbol: CLDN15
  Gene Name: claudin 15
  ENSP ID: ENSP00000390230
MSMAVETFGFFMATVGLLMLGVTLPNSYWRVSTVHGNVITTNTIFENLWFSCATDSLGVYNCWEFPSMLALSGIAGLRCTNIGGLELSRKAKLAATAGALHILAGICGMVAISWYAFNITRDFFDPLYPGTKYELGPALYLGWSASLISILGGLCLCSACCCGSDEDPAA

SEQ ID NO: 17539 - protein, 148 aa, Homo sapiens
  Payload ID: 3526
  Gene Symbol: CLDN15
  Gene Name: claudin 15
  ENSP ID: ENSP00000398418
MSMAVETFGFFMATVGLLMLGVTLPNSYWRVSTVHGNVITTNTIFENLWFSCATDSLGVYNCWEFPSMLALSGICGMVAISWYAFNITRDFFDPLYPGTKYELGPALYLGWSASLISILGGLCLCSACCCGSDEDPAASARRPYQAPV

SEQ ID NO: 17540 - protein, 106 aa, Homo sapiens
  Payload ID: 3526
  Gene Symbol: CLDN15
  Gene Name: claudin 15
  ENSP ID: ENSP00000405308
  MOD_RES (1)..(1): Any amino acid
XGNVITTNTIFENLWFSCATDSLGVYNCWEFPSMLALSGYIQACRALMITAILLGFLGLLLGIAGLRCTNIGGLELSRKAKLAATAGALHILADLLAANQPIGSVS

SEQ ID NO: 17541 - protein, 128 aa, Homo sapiens
  Payload ID: 3526
  Gene Symbol: CLDN15
  Gene Name: claudin 15
  ENSP ID: ENSP00000481925
MSMAVETFGFFMATVGLLMLGVTLPNSYWRVSTVHGNVITTNTIFENLWFSCATDSLGVYNCWEFPSMLALSGSTDSPASLSGGTGLLVRLMSIKGPCEGRRLASCRLSVRCKEAVCVQGIFRPAGHS

SEQ ID NO: 17542 - protein, 305 aa, Homo sapiens
  Payload ID: 3527
  Gene Symbol: CLDN16
  Gene Name: claudin 16
  Uniprot ID: Q9Y5I7
  ENSP ID: ENSP00000264734
MTSRTPLLVTACLYYSYCNSRHLQQGVRKSKRPVFSHCQVPETQKTDTRHLSGARAGVCPCCHPDGLLATMRDLLQYIACFFAFFSAGFLIVATWTDCWMVNADDSLEVSTKCRGLWWECVTNAFDGIRTCDEYDSILAEHPLKLVVTRALMITADILAGFGFLTLLLGLDCVKFLPDEPYIKVRICFVAGATLLIAGTPGIIGSVWYAVDVYVERSTLVLHNIFLGIQYKFGWSCWLGMAGSLGCFLAGAVLTCCLYLFKDVGPERNYPYSLRKAYSAAGVSMAKSYSAPRTETAKMYAVDTRV

SEQ ID NO: 17543 - protein, 119 aa, Homo sapiens
  Payload ID: 3527
  Gene Symbol: CLDN16
  Gene Name: claudin 16
  ENSP ID: ENSP00000414136
MTSRTPLLVTACLYYSYCNSRHLQQGVRKSKRPVFSHCQVPETQKTDTRHLSGARAGVCPCCHPDGLLATMRDLLQYIACFFAFFSAGFLIVATWTDCWMVNADDSLEMLDLRETILIP

SEQ ID NO: 17544 - protein, 224 aa, Homo sapiens
  Payload ID: 3528
  Gene Symbol: CLDN17
  Gene Name: claudin 17
  Uniprot ID: P56750
  ENSP ID: ENSP00000286808
MAFYPLQIAGLVLGFLGMVGTLATTLLPQWRVSAFVGSNIIVFERLWEGLWMNCIRQARVRLQCKFYSSLLALPPALETARALMCVAVALSLIALLIGICGMKQVQCTGSNERAKAYLLGTSGVLFILTGIFVLIPVSWTANIIIRDFYNPAIHIGQKRELGAALFLGWASAAVLFIGGGLLCGFCCCNRKKQGYRYPVPGYRVPHTDKRRNTTMLSKTSTSYV

SEQ ID NO: 17545 - protein, 261 aa, Homo sapiens
  Payload ID: 3529
  Gene Symbol: CLDN18
  Gene Name: claudin 18
  Uniprot ID: P56856
  ENSP ID: ENSP00000183605
MSTTTCQVVAFLLSILGLAGCIAATGMDMWSTQDLYDNPVTSVFQYEGLWRSCVRQSSGFTECRPYFTILGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 17546 - protein, 261 aa, Homo sapiens
  Payload ID: 3529
  Gene Symbol: CLDN18
  Gene Name: claudin 18
  Uniprot ID: P56856
  ENSP ID: ENSP00000340939
MAVTACQGLGFVVSLIGIAGIIAATCMDQWSTQDLYNNPVTAVFNYQGLWRSCVRESSGFTECRGYFTLLGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 17547 - protein, 146 aa, Homo sapiens
  Payload ID: 3529
  Gene Symbol: CLDN18
  Gene Name: claudin 18
  ENSP ID: ENSP00000419732
MSTTTCQVVAFLLSILGLAGCIAATGMDMWSTQDLYDNPVTSVFQYEGLWRSCVRQSSGFTECRPYFTILGLPAMLQAVRALMIVGIVLGAIGLLVSIFALKCIRIGSMEDSAKANMTLTSGIMFIVSGTHLVRLCSWAGSLEASH

SEQ ID NO: 17548 - protein, 224 aa, Homo sapiens
  Payload ID: 3530
  Gene Symbol: CLDN19
  Gene Name: claudin 19
  Uniprot ID: Q8N6F1
  ENSP ID: ENSP00000296387
MANSGLQLLGYFLALGGWVGIIASTALPQWKQSSYAGDAIITAVGLYEGLWMSCASQSTGQVQCKLYDSLLALDGHIQSARALMVVAVLLGFVAMVLSVVGMKCTRVGDSNPIAKGRVAIAGGALFILAGLCTLTAVSWYATLVTQEFFNPSTPVNARYEFGPALFVGWASAGLAVLGGSFLCCTCPEPERPNSSPQPYRPGPSAAAREPVVKLPASAKGPLGV

SEQ ID NO: 17549 - protein, 211 aa, Homo sapiens
  Payload ID: 3530
  Gene Symbol: CLDN19
  Gene Name: claudin 19
  Uniprot ID: Q8N6F1
  ENSP ID: ENSP00000361617
MANSGLQLLGYFLALGGWVGIIASTALPQWKQSSYAGDAIITAVGLYEGLWMSCASQSTGQVQCKLYDSLLALDGHIQSARALMVVAVLLGFVAMVLSVVGMKCTRVGDSNPIAKGRVAIAGGALFILAGLCTLTAVSWYATLVTQEFFNPSTPVNARYEFGPALFVGWASAGLAVLGGSFLCCTCPEPERPNSSPQPYRPGPSAAAREYV

SEQ ID NO: 17550 - protein, 218 aa, Homo sapiens
  Payload ID: 3530
  Gene Symbol: CLDN19
  Gene Name: claudin 19
  Uniprot ID: Q8N6F1
  ENSP ID: ENSP00000443229
MANSGLQLLGYFLALGGWVGIIASTALPQWKQSSYAGDAIITAVGLYEGLWMSCASQSTGQVQCKLYDSLLALDGHIQSARALMVVAVLLGFVAMVLSVVGMKCTRVGDSNPIAKGRVAIAGGALFILAGMNLAQPCSWAGPQLAWPCWAAPSSAAHARSQRDPTAAHSPIGLDPLLLPESTSELRLPWPAPHPVAPLPSIQPASQHPGQGHWGIGWA

SEQ ID NO: 17551 - protein, 230 aa, Homo sapiens
  Payload ID: 3531
  Gene Symbol: CLDN2
  Gene Name: claudin 2
  Uniprot ID: P57739
  ENSP ID: ENSP00000336571
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYSPLVPDSMKFEIGEALYLGIISSLFSLIAGIILCFSCSSQRNRSNYYDAYQAQPLATRSSPRPGQPPKVKSEFNSYSLTGYV

SEQ ID NO: 17552 - protein, 230 aa, Homo sapiens; identical to SEQ ID NO: 17551
  Payload ID: 3531
  Gene Symbol: CLDN2
  Gene Name: claudin 2
  Uniprot ID: P57739
  ENSP ID: ENSP00000441283

SEQ ID NO: 17553 - protein, 230 aa, Homo sapiens; identical to SEQ ID NO: 17551
  Payload ID: 3531
  Gene Symbol: CLDN2
  Gene Name: claudin 2
  Uniprot ID: P57739
  ENSP ID: ENSP00000443230

SEQ ID NO: 17554 - protein, 219 aa, Homo sapiens
  Payload ID: 3532
  Gene Symbol: CLDN20
  Gene Name: claudin 20
  Uniprot ID: P56880
  ENSP ID: ENSP00000356133
MASAGLQLLAFILALSGVSGVLTATLLPNWKVNVDVDSNIITAIVQLHGLWMDCTWYSTGMFSCALKHSILSLPIHVQAARATMVLACVLSALGICTSTVGMKCTRLGGDRETKSHASFAGGVCFMSAGISSLISTVWYTKEIIANFLDLTVPESNKHEPGGAIYIGFISAMLLFISGMIFCTSCIKRNPEARLDPPTQQPISNTQLENNSTHNLKDYV

SEQ ID NO: 17555 - protein, 220 aa, Homo sapiens
  Payload ID: 3533
  Gene Symbol: CLDN22
  Gene Name: claudin 22
  Uniprot ID: Q8N7P3
  ENSP ID: ENSP00000318113
MALVFRTVAQLAGVSLSLLGWVLSCLTNYLPHWKNLNLDLNEMENWTMGLWQTCVIQEEVGMQCKDFDSFLALPAELRVSRILMFLSNGLGFLGLLVSGFGLDCLRIGESQRDLKRRLLILGGILSWASGVTALVPVSWVAHKTVQEFWDENVPDFVPRWEFGEALFLGWFAGLSLLLGGCLLHCAACSSHAPLASGHYAVAQTQDHHQELETRNTNLKH

SEQ ID NO: 17556 - protein, 292 aa, Homo sapiens
  Payload ID: 3534
  Gene Symbol: CLDN23
  Gene Name: claudin 23
  Uniprot ID: Q96B33
  ENSP ID: ENSP00000428780
MRTPVVMTLGMVLAPCGLLLNLTGTLAPGWRLVKGFLNQPVDVELYQGLWDMCREQSSRERECGQTDQWGYFEAQPVLVARALMVTSLAATVLGLLLASLGVRCWQDEPNFVLAGLSGVVLFVAGLLGLIPVSWYNHFLGDRDVLPAPASPVTVQVSYSLVLGYLGSCLLLLGGFSLALSFAPWCDERCRRRRKGPSAGPRRSSVSTIQVEWPEPDLAPAIKYYSDGQHRPPPAQHRKPKPKPKVGFPMPRPRPKAYTNSVDVLDGEGWESQDAPSCSTHPCDSSLPCDSDL

SEQ ID NO: 17557 - protein, 197 aa, Homo sapiens
  Payload ID: 3535
  Gene Symbol: CLDN24
  Gene Name: claudin 24
  ENSP ID: ENSP00000422519
MQSVGLLLSLLGWILSIITTYLPHWKNLNLDLNEMENWTMGLWQTCVIQEEVGMQCKDFDSFLALPAELRVSRILMFLSNGLGFLGLLVSGFGLDCLRIGESQRDLKRRLLILGGILSWASGITALVPVSWVAHKTVQEFWDENVPDFVPRWEFGEALFLGWFAGLSLLLGGCLLNCAACSSHAPLALGHYAVAQMQ

SEQ ID NO: 17558 - protein, 220 aa, Homo sapiens
  Payload ID: 3535
  Gene Symbol: CLDN24
  Gene Name: claudin 24
  Uniprot ID: A6NM45
  ENSP ID: ENSP00000438400
MALIFRTAMQSVGLLLSLLGWILSIITTYLPHWKNLNLDLNEMENWTMGLWQTCVIQEEVGMQCKDFDSFLALPAELRVSRILMFLSNGLGFLGLLVSGFGLDCLRIGESQRDLKRRLLILGGILSWASGITALVPVSWVAHKTVQEFWDENVPDFVPRWEFGEALFLGWFAGLSLLLGGCLLNCAACSSHAPLALGHYAVAQMQTQCPYLEDGTADPQV

SEQ ID NO: 17559 - protein, 229 aa, Homo sapiens
  Payload ID: 3536
  Gene Symbol: CLDN25
  Gene Name: claudin 25
  Uniprot ID: C9JDP6
  ENSP ID: ENSP00000396304
MAWSFRAKVQLGGLLLSLLGWVCSCVTTILPQWKTLNLELNEMETWIMGIWEVCVDREEVATVCKAFESFLSLPQELQVARILMVASHGLGLLGLLLCSFGSECFQFHRIRWVFKRRLGLLGRTLEASASATTLLPVSWVAHATIQDFWDDSIPDIIPRWEFGGALYLGWAAGIFLALGGLLLIFSACLGKEDVPFPLMAGPTVPLSCAPVEESDGSFHLMLRPRNLVI

SEQ ID NO: 17560 - protein, 220 aa, Homo sapiens
  Payload ID: 3537
  Gene Symbol: CLDN3
  Gene Name: claudin 3
  Uniprot ID: O15551
  ENSP ID: ENSP00000378577
MSMGLEITGTALAVLGWLGTIVCCALPMWRVSAFIGSNIITSQNIWEGLWMNCVVQSTGQMQCKVYDSLLALPQDLQAARALIVVAILLAAFGLLVALVGAQCTNCVQDDTAKAKITIVAGVLFLLAALLTLVPVSWSANTIIRDFYNPVVPEAQKREMGAGLYVGWAAAALQLLGGALLCCSCPPREKKYTATKVVYSAPRSTGPGASLGTGYDRKDYV

SEQ ID NO: 17561 - protein, 214 aa, Homo sapiens
  Payload ID: 3538
  Gene Symbol: CLDN34
  Gene Name: claudin 34
  Uniprot ID: H7C241
  ENSP ID: ENSP00000403980
MVWFCNSADCQFSVFALTTIGWILSSTSTGLVEWRIWYMKDTSLYPPGIACVGIFRVCIYRRRTNSTTTKFCYRYSYQDTFLPFEISMAQRFLLTASIFGFFGRAFNMFALRNMSMRMFEEDTYNSFVVSGILNIAAGVFNLIAVLQNYDAVINSQGITFLPSLQMPFKPDVQEVGTAIQVAGIGVLPMLLTGMFSLFYKCPPYGQVHPGISEM

SEQ ID NO: 17562 - protein, 209 aa, Homo sapiens
  Payload ID: 3539
  Gene Symbol: CLDN4
  Gene Name: claudin 4
  Uniprot ID: O14493
  ENSP ID: ENSP00000342445
MASMGLQVMGIALAVLGWLAVMLCCALPMWRVTAFIGSNIVTSQTIWEGLWMNCVVQSTGQMQCKVYDSLLALPQDLQAARALVIISIIVAALGVLLSVVGGKCTNCLEDESAKAKTMIVAGVVFLLAGLMVIVPVSWTAHNIIQDFYNPLVASGQKREMGASLYVGWAASGLLLLGGGLLCCNCPPRTDKPYSAKYSAARSAAASNYV

SEQ ID NO: 17563 - protein, 209 aa, Homo sapiens; identical to SEQ ID NO: 17562
  Payload ID: 3539
  Gene Symbol: CLDN4
  Gene Name: claudin 4
  Uniprot ID: O14493
  ENSP ID: ENSP00000388639

SEQ ID NO: 17564 - protein, 209 aa, Homo sapiens; identical to SEQ ID NO: 17562
  Payload ID: 3539
  Gene Symbol: CLDN4
  Gene Name: claudin 4
  Uniprot ID: O14493
  ENSP ID: ENSP00000409544

SEQ ID NO: 17565 - protein, 303 aa, Homo sapiens
  Payload ID: 3540
  Gene Symbol: CLDN5
  Gene Name: claudin 5
  ENSP ID: ENSP00000384554
MTRARIGCFGPGGRARGTESAPEPSKRVPPGRSWQTQEVRQTRGANGLGPRAGSAGAKAPGPAQGAAQHGLGGSAGLRVRVSPLAMGSAALEILGLVLCLVGWGGLILACGLPMWQVTAFLDHNIVTAQTTWKGLWMSCVVQSTGHMQCKVYDSVLALSTEVQAARALTVSAVLLAFVALFVTLAGAQCTTCVAPGPAKARVALTGGVLYLFCGLLALVPLCWFANIVVREFYDPSVPVSQKYELGAALYIGWAATALLMVGGCLLCCGAWVCTGRPDLSFPVKYSAPRRPTATGDYDKKNYV

SEQ ID NO: 17566 - protein, 303 aa, Homo sapiens; identical to SEQ ID NO: 17565
  Payload ID: 3540
  Gene Symbol: CLDN5
  Gene Name: claudin 5
  ENSP ID: ENSP00000385477

SEQ ID NO: 17567 - protein, 303 aa, Homo sapiens; identical to SEQ ID NO: 17565
  Payload ID: 3540
  Gene Symbol: CLDN5
  Gene Name: claudin 5
  ENSP ID: ENSP00000400612

SEQ ID NO: 17568 - protein, 218 aa, Homo sapiens
  Payload ID: 3540
  Gene Symbol: CLDN5
  Gene Name: claudin 5
  Uniprot ID: O00501
  ENSP ID: ENSP00000480623
MGSAALEILGLVLCLVGWGGLILACGLPMWQVTAFLDHNIVTAQTTWKGLWMSCVVQSTGHMQCKVYDSVLALSTEVQAARALTVSAVLLAFVALFVTLAGAQCTTCVAPGPAKARVALTGGVLYLFCGLLALVPLCWFANIVVREFYDPSVPVSQKYELGAALYIGWAATALLMVGGCLLCCGAWVCTGRPDLSFPVKYSAPRRPTATGDYDKKNYV

SEQ ID NO: 17569 - protein, 220 aa, Homo sapiens
  Payload ID: 3541
  Gene Symbol: CLDN6
  Gene Name: claudin 6
  Uniprot ID: P56747
  ENSP ID: ENSP00000328674
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 17570 - protein, 220 aa, Homo sapiens; identical to SEQ ID NO: 17569
  Payload ID: 3541
  Gene Symbol: CLDN6
  Gene Name: claudin 6
  Uniprot ID: P56747
  ENSP ID: ENSP00000380131

SEQ ID NO: 17571 - protein, 39 aa, Homo sapiens
  Payload ID: 3541
  Gene Symbol: CLDN6
  Gene Name: claudin 6
  ENSP ID: ENSP00000458783
MASAGMQILGVVLTLLGWVNGLVSCALPMWKALLFLTLG

SEQ ID NO: 17572 - protein, 211 aa, Homo sapiens
  Payload ID: 3542
  Gene Symbol: CLDN7
  Gene Name: claudin 7
  Uniprot ID: O95471
  ENSP ID: ENSP00000353475
MANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVAGLAALVACSWYGHQIVTDFYNPLIPTNIKYEFGPAIFIGWAGSALVILGGALLSCSCPGNESKAGYRVPRSYPKSNSSKEYV

SEQ ID NO: 17573 - protein, 211 aa, Homo sapiens; identical to SEQ ID NO: 17572
  Payload ID: 3542
  Gene Symbol: CLDN7
  Gene Name: claudin 7
  Uniprot ID: O95471
  ENSP ID: ENSP00000396638

SEQ ID NO: 17574 - protein, 145 aa, Homo sapiens
  Payload ID: 3542
  Gene Symbol: CLDN7
  Gene Name: claudin 7
  ENSP ID: ENSP00000445131
MANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVAGMSLALPSLLAGQGLP

SEQ ID NO: 17575 - protein, 99 aa, Homo sapiens
  Payload ID: 3542
  Gene Symbol: CLDN7
  Gene Name: claudin 7
  ENSP ID: ENSP00000460550
MVVSLVLGFLAMFVATMGMKCTRCGGDDKVKKARIAMGGGIIFIVAGLAALVACSWYGHQIVTDFYNPLIPTNIKYEFGPAIFIGWAGSALVILGGALL

SEQ ID NO: 17576 - protein, 193 aa, Homo sapiens
  Payload ID: 3542
  Gene Symbol: CLDN7
  Gene Name: claudin 7
  ENSP ID: ENSP00000460796
MPEGTVGLPARRPQCFLRAEMANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVAGLAALVACSWYGHQIVTDFYNPLIPTNIKYEFGPAIFIGWAGSA

SEQ ID NO: 17577 - protein, 140 aa, Homo sapiens
  Payload ID: 3542
  Gene Symbol: CLDN7
  Gene Name: claudin 7
  ENSP ID: ENSP00000465963
MANSGLQLLGFSMALLGWVGLVACTAIPQWQMSSYAGDNIITAQAMYKGLWMDCVTQSTGMMSCKIGLAGHSSPNGGLPGAGLPGHVCGHDGHEVHALWGRRQSEEGPYSHGWRHNFHRGRSCRLGSLLLVWPSDCHRLL

SEQ ID NO: 17578 - protein, 129 aa, Homo sapiens
  Payload ID: 3542
  Gene Symbol: CLDN7
  Gene Name: claudin 7
  ENSP ID: ENSP00000467220
MANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVA

SEQ ID NO: 17579 - protein, 225 aa, Homo sapiens
  Payload ID: 3543
  Gene Symbol: CLDN8
  Gene Name: claudin 8
  Uniprot ID: P56748
  ENSP ID: ENSP00000382783
MATHALEIAGLFLGGVGMVGTVAVTVMPQWRVSAFIENNIVVFENFWEGLWMNCVRQANIRMQCKIYDSLLALSPDLQAARGLMCAASVMSFLAFMMAILGMKCTRCTGDNEKVKAHILLTAGIIFIITGMVVLIPVSWVANAIIRDFYNSIVNVAQKRELGEALYLGWTTALVLIVGGALFCCVFCCNEKSSSYRYSIPSHRTTQKSYHTGKKSPSVYSRSQYV

SEQ ID NO: 17580 - protein, 217 aa, Homo sapiens
  Payload ID: 3544
  Gene Symbol: CLDN9
  Gene Name: claudin 9
  Uniprot ID: O95484
  ENSP ID: ENSP00000398017
MASTGLELLGMTLAVLGWLGTLVSCALPLWKVTAFIGNSIVVAQVVWEGLWMSCVVQSTGQMQCKVYDSLLALPQDLQAARALCVIALLLALLGLLVAITGAQCTTCVEDEGAKARIVLTAGVILLLAGILVLIPVCWTAHAIIQDFYNPLVAEALKRELGASLYLGWAAAALLMLGGGLLCCTCPPPQVERPRGPRLGYSIPSRSGASGLDKRDYV

SEQ ID NO: 17581 - protein, 253 aa, Homo sapiens
  Payload ID: 3545
  Gene Symbol: CLDND1
  Gene Name: claudin domain containing 1
  Uniprot ID: Q9NY35
  ENSP ID: ENSP00000340247
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 17582 - protein, 253 aa, Homo sapiens; identical to SEQ ID NO: 17581
  Payload ID: 3545
  Gene Symbol: CLDND1
  Gene Name: claudin domain containing 1
  Uniprot ID: Q9NY35
  ENSP ID: ENSP00000377734

SEQ ID NO: 17583 - protein, 276 aa, Homo sapiens
  Payload ID: 3545
  Gene Symbol: CLDND1
  Gene Name: claudin domain containing 1
  ENSP ID: ENSP00000377735
MGGDRLENKTSVSVASWSSLNARMDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 17584 - protein, 253 aa, Homo sapiens; identical to SEQ ID NO: 17581
  Payload ID: 3545
  Gene Symbol: CLDND1
  Gene Name: claudin domain containing 1
  Uniprot ID: Q9NY35
  ENSP ID: ENSP00000377739

SEQ ID NO: 17585 - protein, 239 aa, Homo sapiens
  Payload ID: 3545
  Gene Symbol: CLDND1
  Gene Name: claudin domain containing 1
  ENSP ID: ENSP00000420913
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHT

SEQ ID NO: 17586 - protein, 253 aa, Homo sapiens; identical to SEQ ID NO: 17581
  Payload ID: 3545
  Gene Symbol: CLDND1
  Gene Name: claudin domain containing 1
  Uniprot ID: Q9NY35
  ENSP ID: ENSP00000421226

SEQ ID NO: 17587 - protein, 236 aa, Homo sapiens
  Payload ID: 3545
  Gene Symbol: CLDND1
  Gene Name: claudin domain containing 1
  ENSP ID: ENSP00000421413
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWA

SEQ ID NO: 17588 - protein, 155 aa, Homo sapiens
  Payload ID: 3545
  Gene Symbol: CLDND1
  Gene Name: claudin domain containing 1
  ENSP ID: ENSP00000422116
KSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAAQYYKERFTIMTLQSWETYHKI

SEQ ID NO: 17589 - protein, 210 aa, Homo sapiens
  Payload ID: 3545
  Gene Symbol: CLDND1
  Gene Name: claudin domain containing 1
  ENSP ID: ENSP00000422428
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAVTKESMLPAGAESKHTATPAHACVQTGKPK

SEQ ID NO: 17590 - protein, 180 aa, Homo sapiens
  Payload ID: 3545
  Gene Symbol: CLDND1
  Gene Name: claudin domain containing 1
  ENSP ID: ENSP00000423093
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLA

SEQ ID NO: 17591 - protein, 213 aa, Homo sapiens
  Payload ID: 3545
  Gene Symbol: CLDND1
  Gene Name: claudin domain containing 1
  ENSP ID: ENSP00000423151
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFG

SEQ ID NO: 17592 - protein, 253 aa, Homo sapiens; identical to SEQ ID NO: 17581
  Payload ID: 3545
  Gene Symbol: CLDND1
  Gene Name: claudin domain containing 1
  Uniprot ID: Q9NY35
  ENSP ID: ENSP00000423590

SEQ ID NO: 17593 - protein, 87 aa, Homo sapiens
  Payload ID: 3545
  Gene Symbol: CLDND1
  Gene Name: claudin domain containing 1
  ENSP ID: ENSP00000423592
MGESFDVVTKCVSFTLTEQFMEKFVDPGNHNSGIDLLRTYLWRCQFLLPFVSLGLMCFGALIGLCACICRSLYPTIATGILHLLAEN

SEQ ID NO: 17594 - protein, 223 aa, Homo sapiens
  Payload ID: 3545
  Gene Symbol: CLDND1
  Gene Name: claudin domain containing 1
  ENSP ID: ENSP00000423732
MAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYT

SEQ ID NO: 17595 - protein, 100 aa, Homo sapiens
  Payload ID: 3545
  Gene Symbol: CLDND1
  Gene Name: claudin domain containing 1
  ENSP ID: ENSP00000424484
MEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWS

SEQ ID NO: 17596 - protein, 106 aa, Homo sapiens
  Payload ID: 3545
  Gene Symbol: CLDND1
  Gene Name: claudin domain containing 1
  ENSP ID: ENSP00000424589
MDNRFATAFVIACVLSLISTIYMAASIGTDFWYEYRSPVQENSSDLNKSIWDEFISDEADEKTYNDALFRYNGTVGLWRRCITIPKNMHWYSPPERTGNCSCSRVI

SEQ ID NO: 17597 - protein, 158 aa, Homo sapiens
  Payload ID: 3545
  Gene Symbol: CLDND1
  Gene Name: claudin domain containing 1
  Uniprot ID: Q9NY35
  ENSP ID: ENSP00000424669
MGESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 17598 - protein, 177 aa, Homo sapiens
  Payload ID: 3545
  Gene Symbol: CLDND1
  Gene Name: claudin domain containing 1
  ENSP ID: ENSP00000425204
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILH

SEQ ID NO: 17599 - protein, 145 aa, Homo sapiens
  Payload ID: 3545
  Gene Symbol: CLDND1
  Gene Name: claudin domain containing 1
  ENSP ID: ENSP00000425256
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPF

SEQ ID NO: 17600 - protein, 244 aa, Homo sapiens
  Payload ID: 3545
  Gene Symbol: CLDND1
  Gene Name: claudin domain containing 1
  ENSP ID: ENSP00000425539
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEY

SEQ ID NO: 17601 - protein, 72 aa, Homo sapiens
  Payload ID: 3545
  Gene Symbol: CLDND1
  Gene Name: claudin domain containing 1
  ENSP ID: ENSP00000426164
FVSLGLMCFGALIGLCACICRSLYPTIATGILHLLAGLCTLGSVSCYVAGIELLHQKLELPDNPSTIKNVSP

SEQ ID NO: 17602 - protein, 253 aa, Homo sapiens; identical to SEQ ID NO: 17581
  Payload ID: 3545
  Gene Symbol: CLDND1
  Gene Name: claudin domain containing 1
  Uniprot ID: Q9NY35
  ENSP ID: ENSP00000426869

SEQ ID NO: 17603 - protein, 89 aa, Homo sapiens
  Payload ID: 3545
  Gene Symbol: CLDND1
  Gene Name: claudin domain containing 1
  ENSP ID: ENSP00000427042
MDNRFATAFVIACVLSLISTIYMAASIGTDFWYEYRSPVQENSSDLNKSIWDEFISDEADEKTYNDALFRYNGTVGLWRRCITIPKNMH

SEQ ID NO: 17604 - protein, 121 aa, Homo sapiens
  Payload ID: 3545
  Gene Symbol: CLDND1
  Gene Name: claudin domain containing 1
  ENSP ID: ENSP00000427119
MEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWA

SEQ ID NO: 17605 - protein, 138 aa, Homo sapiens
  Payload ID: 3545
  Gene Symbol: CLDND1
  Gene Name: claudin domain containing 1
  ENSP ID: ENSP00000427385
MAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLC

SEQ ID NO: 17606 - protein, 172 aa, Homo sapiens
  Payload ID: 3545
  Gene Symbol: CLDND1
  Gene Name: claudin domain containing 1
  ENSP ID: ENSP00000427658
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIA

SEQ ID NO: 17607 - protein, 167 aa, Homo sapiens
  Payload ID: 3546
  Gene Symbol: CLDND2
  Gene Name: claudin domain containing 2
  Uniprot ID: Q8NHS1
  ENSP ID: ENSP00000291715
MGVKRSLQSGGILLSLVANVLMVLSTATNYWTRQQEGHSGLWQECNHGICSSIPCQTTLAVTVACMVLAVGVGVVGMVMGLRIRCDEGESLRGQTTSAFLFLGGLLLLTALIGYTVKNAWKNNVFFSWSYFSGWLALPFSILAGFCFLLADMIMQSTDAISGFPVCL

SEQ ID NO: 17608 - protein, 109 aa, Homo sapiens
  Payload ID: 3546
  Gene Symbol: CLDND2
  Gene Name: claudin domain containing 2
  ENSP ID: ENSP00000471912
  MOD_RES (1)..(1): Any amino acid
XVVGMVMGLRIRCDEGESLRGQTTSAFLFLGGLLLLTALIGSPAALPGNPGDLSGTPQHTNDSRRPGRDPLGAPNPSPRGPPGHPPQGPPSSPCSAPPSPQASAFCWQT

SEQ ID NO: 17609 - protein, 167 aa, Homo sapiens; identical to SEQ ID NO: 17607
  Payload ID: 3546
  Gene Symbol: CLDND2
  Gene Name: claudin domain containing 2
  Uniprot ID: Q8NHS1
  ENSP ID: ENSP00000472077

SEQ ID NO: 17610 - protein, 354 aa, Homo sapiens
  Payload ID: 3547
  Gene Symbol: CLVS1
  Gene Name: clavesin 1
  Uniprot ID: Q8IUQ0
  ENSP ID: ENSP00000325506
MGPVSLLPKYQKLNTWNGDLAKMTHLQAGLSPETIEKARLELNENPDVLHQDIQQVRDMIITRPDIGFLRTDDAFILRFLRARKFHQADAFRLLAQYFQYRQLNLDMFKNFKADDPGIKRALIDGFPGVLENRDHYGRKILLLFAANWDQSRNSFTDILRAILLSLEVLIEDPELQINGFILIIDWSNFSFKQASKLTPSILKLAIEGLQDSFPARFGGVHFVNQPWYIHALYTLIKPFLKDKTRKRIFLHGNNLNSLHQLIHPEFLPSEFGGTLPPYDMGTWARTLLGPDYSDENDYTHTSYNAMHVKHTSSNLERECSPKLMKRSQSVVEAGTLKHEEKGENENTQPLLALD

SEQ ID NO: 17611 - protein, 2 aa, Homo sapiens
  Payload ID: 3547
  Gene Symbol: CLVS1
  Gene Name: clavesin 1
  ENSP ID: ENSP00000428174
MG

SEQ ID NO: 17612 - protein, 354 aa, Homo sapiens; identical to SEQ ID NO: 17610
  Payload ID: 3547
  Gene Symbol: CLVS1
  Gene Name: clavesin 1
  Uniprot ID: Q8IUQ0
  ENSP ID: ENSP00000428402

SEQ ID NO: 17613 - protein, 79 aa, Homo sapiens
  Payload ID: 3547
  Gene Symbol: CLVS1
  Gene Name: clavesin 1
  ENSP ID: ENSP00000428986
MGPVSLLPKYQKLNTWNGDLAKMTHLQAGLSPETIEKARLELNENPDVLHQDIQQVRDMIITRPDIGFLRTDDAFILRF

SEQ ID NO: 17614 - protein, 10 aa, Homo sapiens
  Payload ID: 3547
  Gene Symbol: CLVS1
  Gene Name: clavesin 1
  ENSP ID: ENSP00000429244
MGPVSLLPKY

SEQ ID NO: 17615 - protein, 59 aa, Homo sapiens
  Payload ID: 3547
  Gene Symbol: CLVS1
  Gene Name: clavesin 1
  ENSP ID: ENSP00000429544
MGTWARTLLGPDYSDENDYTHTSYNAMHVKHTSSNLERECSPKLMKRSQSVVEAGTLKH

SEQ ID NO: 17616 - protein, 75 aa, Homo sapiens
  Payload ID: 3547
  Gene Symbol: CLVS1
  Gene Name: clavesin 1
  ENSP ID: ENSP00000429869
MGTWARTLLGPDYSDENDYTHTSYNAMHVKHTSSNLERECSPKLMKRSQSVVEAGTLKHEEKGENENTQPLLALD

SEQ ID NO: 17617 - protein, 327 aa, Homo sapiens
  Payload ID: 3548
  Gene Symbol: CLVS2
  Gene Name: clavesin 2
  Uniprot ID: Q5SYC1
  ENSP ID: ENSP00000275162
MTHLQAGLSPETLEKARLELNENPDTLHQDIQEVRDMVITRPDIGFLRTDDAFILRFLRARKFHHFEAFRLLAQYFEYRQQNLDMFKSFKATDPGIKQALKDGFPGGLANLDHYGRKILVLFAANWDQSRYTLVDILRAILLSLEAMIEDPELQVNGFVLIIDWSNFTFKQASKLTPSMLRLAIEGLQDSFPARFGGIHFVNQPWYIHALYTVIRPFLKEKTRKRIFLHGNNLNSLHQLIHPEILPSEFGGMLPPYDMGTWARTLLDHEYDDDSEYNVDSYSMPVKEVEKELSPKSMKRSQSVVDPTVLKRMDKNEEENMQPLLSLD

SEQ ID NO: 17618 - protein, 181 aa, Homo sapiens
  Payload ID: 3548
  Gene Symbol: CLVS2
  Gene Name: clavesin 2
  Uniprot ID: Q5SYC1
  ENSP ID: ENSP00000357423
MIEDPELQVNGFVLIIDWSNFTFKQASKLTPSMLRLAIEGLQDSFPARFGGIHFVNQPWYIHALYTVIRPFLKEKTRKRIFLHGNNLNSLHQLIHPEILPSEFGGMLPPYDMGTWARTLLDHEYDDDSEYNVDSYSMPVKEVEKELSPKSMKRSQSVVDPTVLKRMDKNEEENMQPLLSLD

SEQ ID NO: 17619 - protein, 361 aa, Homo sapiens
  Payload ID: 3549
  Gene Symbol: CLP1
  Gene Name: cleavage and polyadenylation factor I subunit 1
  Uniprot ID: Q92989
  ENSP ID: ENSP00000304704
MGEEANDDKKPTTKFELERETELRFEVEASQSVQLELLTGMAEIFGTELTRNKKFTFDAGAKVAVFTWHGCSVQLSGRTEVAYVSKDTPMLLYLNTHTALEQMRRQAEKEEERGPRVMVVGPTDVGKSTVCRLLLNYAITSRLADVFNQRCEVNRRASVSGCVINTCGWVKGSGYQALVHAASAFEVDVVVVLDQERLYNELKRDLPHFVRTVLLPKSGGVVERSKDFRRECRDERIREYFYGFRGCFYPHAFNVKFSDVKIYKVGAPTIPDSCLPLGMSQEDNQLKLVPVTPGRDMVHHLLSVSTAEGTEENLSETSVAGFIVVTSVDLEHQVFTVLSPAPRPLPKNFLLIMDIRFMDLK

SEQ ID NO: 17620 - protein, 132 aa, Homo sapiens
  Payload ID: 3549
  Gene Symbol: CLP1
  Gene Name: cleavage and polyadenylation factor I subunit 1
  ENSP ID: ENSP00000431744
MGEEANDDKKPTTKFELERETELRFEVEASQSVQLELLTGMAEIFGTELTRNKKFTFDAGAKVAVFTWHGCSVQLSGRTEVAYVSKDTPMLLYLNTHTALEQMRRQAEKEEERGPRVMVVGPTDVGKSTVCR

SEQ ID NO: 17621 - protein, 436 aa, Homo sapiens
  Payload ID: 3549
  Gene Symbol: CLP1
  Gene Name: cleavage and polyadenylation factor I subunit 1
  ENSP ID: ENSP00000433406
MTDLHSSYTEEMGEEANDDKKPTTKFELERETELRFEVEASQSVQLELLTGMAEIFGTELTRNKKFTFDAGAKVAVFTWHGCSVQLSGRTEVAYVSKDTPMLLYLNTHTALEQMRRQAEKEEERGPRVMVVGPTDVGKSTVCRLLLNYAVRLGRRPTYVELDVGQGSVSIPGTMGALYIERPADVEEGFSIQAPLVYHFGSTTPGTNIKLYNKITSRLADVFNQRCEVNRRASVSGCVINTCGWVKGSGYQALVHAASAFEVDVVVVLDQERLYNELKRDLPHFVRTVLLPKSGGVVERSKDFRRECRDERIREYFYGFRGCFYPHAFNVKFSDVKIYKVGAPTIPDSCLPLGMSQEDNQLKLVPVTPGRDMVHHLLSVSTAEGTEENLSETSVAGFIVVTSVDLEHQVFTVLSPAPRPLPKNFLLIMDIRFMDLK

SEQ ID NO: 17622 - protein, 425 aa, Homo sapiens
  Payload ID: 3549
  Gene Symbol: CLP1
  Gene Name: cleavage and polyadenylation factor I subunit 1
  Uniprot ID: Q92989
  ENSP ID: ENSP00000434995
MGEEANDDKKPTTKFELERETELRFEVEASQSVQLELLTGMAEIFGTELTRNKKFTFDAGAKVAVFTWHGCSVQLSGRTEVAYVSKDTPMLLYLNTHTALEQMRRQAEKEEERGPRVMVVGPTDVGKSTVCRLLLNYAVRLGRRPTYVELDVGQGSVSIPGTMGALYIERPADVEEGFSIQAPLVYHFGSTTPGTNIKLYNKITSRLADVFNQRCEVNRRASVSGCVINTCGWVKGSGYQALVHAASAFEVDVVVVLDQERLYNELKRDLPHFVRTVLLPKSGGVVERSKDFRRECRDERIREYFYGFRGCFYPHAFNVKFSDVKIYKVGAPTIPDSCLPLGMSQEDNQLKLVPVTPGRDMVHHLLSVSTAEGTEENLSETSVAGFIVVTSVDLEHQVFTVLSPAPRPLPKNFLLIMDIRFMDLK

SEQ ID NO: 17623 - protein, 92 aa, Homo sapiens
  Payload ID: 3549
  Gene Symbol: CLP1
  Gene Name: cleavage and polyadenylation factor I subunit 1
  ENSP ID: ENSP00000435287
MGEEANDDKKPTTKFELERETELRFEVEASQSVQLELLTGMAEIFGTELTRNKKFTFDAGAKVAVFTWHGCSVQLSGRTEVAYVSKDTPMLL

SEQ ID NO: 17624 - protein, 425 aa, Homo sapiens; identical to SEQ ID NO: 17622
  Payload ID: 3549
  Gene Symbol: CLP1
  Gene Name: cleavage and polyadenylation factor I subunit 1
  Uniprot ID: Q92989
  ENSP ID: ENSP00000436066

SEQ ID NO: 17625 - protein, 148 aa, Homo sapiens
  Payload ID: 3550
  Gene Symbol: CPSF1
  Gene Name: cleavage and polyadenylation specific factor 1, 160kDa
  ENSP ID: ENSP00000435761
MYAVYKQAHPPTGLEFSMYCNFFNNSERNLVVAGTSQLYVYRLNRDAEALTKNDRSTEGKAHREKLELAASFSFFGNVMSMASVQLAGAKRDALLLSFKDAKLSVVEYDPGTHDLKTLSLHYFEEPELRDRAAGVGACDLHEDSVSAQ

SEQ ID NO: 17626 - protein, 1443 aa, Homo sapiens
  Payload ID: 3550
  Gene Symbol: CPSF1
  Gene Name: cleavage and polyadenylation specific factor 1, 160kDa
  Uniprot ID: Q10570
  ENSP ID: ENSP00000478145
MYAVYKQAHPPTGLEFSMYCNFFNNSERNLVVAGTSQLYVYRLNRDAEALTKNDRSTEGKAHREKLELAASFSFFGNVMSMASVQLAGAKRDALLLSFKDAKLSVVEYDPGTHDLKTLSLHYFEEPELRDGFVQNVHTPRVRVDPDGRCAAMLVYGTRLVVLPFRRESLAEEHEGLVGEGQRSSFLPSYIIDVRALDEKLLNIIDLQFLHGYYEPTLLILFEPNQTWPGRVAVRQDTCSIVAISLNITQKVHPVIWSLTSLPFDCTQALAVPKPIGGVVVFAVNSLLYLNQSVPPYGVALNSLTTGTTAFPLRTQEGVRITLDCAQATFISYDKMVISLKGGEIYVLTLITDGMRSVRAFHFDKAAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRGATEGLSKKSVVWENKHITWFATLDGGIGLLLPMQEKTYRRLLMLQNALTTMLPHHAGLNPRAFRMLHVDRRTLQNAVRNVLDGELLNRYLYLSTMERSELAKKIGTTPDIILDDLLETDRVTAHF

SEQ ID NO: 17627 - protein, 169 aa, Homo sapiens
  Payload ID: 3550
  Gene Symbol: CPSF1
  Gene Name: cleavage and polyadenylation specific factor 1, 160kDa
  ENSP ID: ENSP00000478161
  MOD_RES (1)..(1): Any amino acid
XPGQPLTKNKFKVLYEKEQKGPVTALCHCNGHLVSAIGQKLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRGATEGLSKKSVVWENKHITWF

SEQ ID NO: 17628 - protein, 204 aa, Homo sapiens
  Payload ID: 3550
  Gene Symbol: CPSF1
  Gene Name: cleavage and polyadenylation specific factor 1, 160kDa
  ENSP ID: ENSP00000483775
MKSISLLRYQEESKTLSLVSRVHLWRRCSCLVSDRDRNLMVYMYLPEAKESFGGMRLLRRADFHVGAHVNTFWRTPCRGATEGLSKKSVVWENKHITWFATLDGGIGLLLPMQEKTYRRLLMLQNALTTMLPHHAGLNPRAFRMLHVDRRTLQNAVRNVLDGELLNRYLYLSTMERSELAKKIGTTPDIILDDLLETDRVTAHF

SEQ ID NO: 17629 - protein, 1443 aa, Homo sapiens; identical to SEQ ID NO: 17626
  Payload ID: 3550
  Gene Symbol: CPSF1
  Gene Name: cleavage and polyadenylation specific factor 1, 160kDa
  Uniprot ID: Q10570
  ENSP ID: ENSP00000484669

SEQ ID NO: 17630 - protein, 782 aa, Homo sapiens
  Payload ID: 3551
  Gene Symbol: CPSF2
  Gene Name: cleavage and polyadenylation specific factor 2, 100kDa
  Uniprot ID: Q9P2I0
  ENSP ID: ENSP00000298875
MTSIIKLTTLSGVQEESALCYLLQVDEFRFLLDCGWDEHFSMDIIDSLRKHVHQIDAVLLSHPDPLHLGALPYAVGKLGLNCAIYATIPVYKMGQMFMYDLYQSRHNTEDFTLFTLDDVDAAFDKIQQLKFSQIVNLKGKGHGLSITPLPAGHMIGGTIWKIVKDGEEEIVYAVDFNHKREIHLNGCSLEMLSRPSLLITDSFNATYVQPRRKQRDEQLLTNVLETLRGDGNVLIAVDTAGRVLELAQLLDQIWRTKDAGLGVYSLALLNNVSYNVVEFSKSQVEWMSDKLMRCFEDKRNNPFQFRHLSLCHGLSDLARVPSPKVVLASQPDLECGFSRDLFIQWCQDPKNSIILTYRTTPGTLARFLIDNPSEKITEIELRKRVKLEGKELEEYLEKEKLKKEAAKKLEQSKEADIDSSDESDIEEDIDQPSAHKTKHDLMMKGEGSRKGSFFKQAKKSYPMFPAPEERIKWDEYGEIIKPEDFLVPELQATEEEKSKLESGLTNGDEPMDQDLSDVPTKCISTTESIEIKARVTYIDYEGRSDGDSIKKIINQMKPRQLIIVHGPPEASQDLAECCRAFGGKDIKVYMPKLHETVDATSETHIYQVRLKDSLVSSLQFCKAKDAELAWIDGVLDMRVSKVDTGVILEEGELKDDGEDSEMQVEAPSDSSVIAQQKAMKSLFGDDEKETGEESEIIPTLEPLPPHEVPGHQSVFMNEPRLSDFKQVLLREGIQAEFVGGVLVCNNQVAVRRTETGRIGLEGCLCQDFYRIRDLLYEQYAIV

SEQ ID NO: 17631 - protein, 269 aa, Homo sapiens
  Payload ID: 3551
  Gene Symbol: CPSF2
  Gene Name: cleavage and polyadenylation specific factor 2, 100kDa
  ENSP ID: ENSP00000451390
  MOD_RES (1)..(1): Any amino acid
XAHKTKHDLMMKGEGSRKGSFFKQAKKSYPMFPAPEERIKWDEYGEIIKARVTYIDYEGRSDGDSIKKIINQMKPRQLIIVHGPPEASQDLAECCRAFGGKDIKVYMPKLHETVDATSETHIYQVRLKDSLVSSLQFCKAKDAELAWIDGVLDMRVSKVDTGVILEEGELKDDGEDSEMQVEAPSDSSVIAQQKAMKSLFGDDEKETGEESEIIPTLEPLPPHEVPGHQSVFMNEPRLSDFKQVLLREGIQAEFVGGVLVCNNQVAVRR

SEQ ID NO: 17632 - protein, 80 aa, Homo sapiens
  Payload ID: 3551
  Gene Symbol: CPSF2
  Gene Name: cleavage and polyadenylation specific factor 2, 100kDa
  ENSP ID: ENSP00000451418
MTSIIKLTTLSGVQEESALCYLLQVDEFRFLLDCGWDEHFSMDIIDSLRKHVHQIDAVLLSHPDPLHLGALPYAVGKLGL

SEQ ID NO: 17633 - protein, 62 aa, Homo sapiens
  Payload ID: 3551
  Gene Symbol: CPSF2
  Gene Name: cleavage and polyadenylation specific factor 2, 100kDa
  ENSP ID: ENSP00000452503
MTSIIKLTTLSGVQEESALCYLLQVDEFRFLLDCGWDEHFSMDIIDSLRNLDTIQKILHSLH

SEQ ID NO: 17634 - protein, 684 aa, Homo sapiens
  Payload ID: 3552
  Gene Symbol: CPSF3
  Gene Name: cleavage and polyadenylation specific factor 3, 73kDa
  Uniprot ID: Q9UKF6
  ENSP ID: ENSP00000238112
MSAIPAEESDQLLIRPLGAGQEVGRSCIILEFKGRKIMLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRKGAVQKVSKKLEMHVYSKRLEIMLQDIFGEDCVSVKDDSILSVTVDGKTANLNLETRTVECEEGSEDDESLREMVELAAQRLYEALTPVH

SEQ ID NO: 17635 - protein, 647 aa, Homo sapiens
  Payload ID: 3552
  Gene Symbol: CPSF3
  Gene Name: cleavage and polyadenylation specific factor 3, 73kDa
  ENSP ID: ENSP00000418957
MLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRKGAVQKVSKKLEMHVYSKRLEIMLQDIFGEDCVSVKDDSILSVTVDGKTANLNLETRTVECEEGSEDDESLREMVELAAQRLYEALTPVH

SEQ ID NO: 17636 - protein, 136 aa, Homo sapiens
  Payload ID: 3552
  Gene Symbol: CPSF3
  Gene Name: cleavage and polyadenylation specific factor 3, 73kDa
  ENSP ID: ENSP00000419744
MLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVK

SEQ ID NO: 17637 - protein, 578 aa, Homo sapiens
  Payload ID: 3553
  Gene Symbol: CPSF3L
  Gene Name: cleavage and polyadenylation specific factor 3-like
  Uniprot ID: Q5TA45
  ENSP ID: ENSP00000392848
MPEIRVTPLGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 17638 - protein, 502 aa, Homo sapiens
  Payload ID: 3553
  Gene Symbol: CPSF3L
  Gene Name: cleavage and polyadenylation specific factor 3-like
  ENSP ID: ENSP00000400548
MPEIRVTPLGACPVLSWNLVLPPGRGSRAPSSTDTRTGFHVLPHGVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 17639 - protein, 101 aa, Homo sapiens
  Payload ID: 3553
  Gene Symbol: CPSF3L
  Gene Name: cleavage and polyadenylation specific factor 3-like
  ENSP ID: ENSP00000404012
MPEIRVTPLGACPVLSWNLVLPPGRGSRAPSSTDTRTGFHVLPHGAAPRLWPRHPDVWCWLWTLRVAGRGRGRPGRGPKLHPGLHCGQECHAGLWNAHGLQ

SEQ ID NO: 17640 - protein, 499 aa, Homo sapiens
  Payload ID: 3553
  Gene Symbol: CPSF3L
  Gene Name: cleavage and polyadenylation specific factor 3-like
  Uniprot ID: Q5TA45
  ENSP ID: ENSP00000404886
MPEIRVTPLGAGQDVGRSCILVSIAGKNVMLDCGMHMGFNDDVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 17641 - protein, 344 aa, Homo sapiens
  Payload ID: 3553
  Gene Symbol: CPSF3L
  Gene Name: cleavage and polyadenylation specific factor 3-like
  ENSP ID: ENSP00000411233
MPEIRVTPLGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQVRFPGPQLAQSLPTPTPTMPSARSTQFLEGWGLRVSPPHLTLASSTVGTPGGVSARMRVPDQTGRRPGRARAGWGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFAD

SEQ ID NO: 17642 - protein, 600 aa, Homo sapiens
  Payload ID: 3553
  Gene Symbol: CPSF3L
  Gene Name: cleavage and polyadenylation specific factor 3-like
  Uniprot ID: Q5TA45
  ENSP ID: ENSP00000413493
MPEIRVTPLGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 17643 - protein, 46 aa, Homo sapiens
  Payload ID: 3553
  Gene Symbol: CPSF3L
  Gene Name: cleavage and polyadenylation specific factor 3-like
  ENSP ID: ENSP00000431214
MPEIRVTPLGAGQDVGRSCILVSIAGKNVMLDCGMHMGFNDDSCLD

SEQ ID NO: 17644 - protein, 34 aa, Homo sapiens
  Payload ID: 3553
  Gene Symbol: CPSF3L
  Gene Name: cleavage and polyadenylation specific factor 3-like
  ENSP ID: ENSP00000431425
  MOD_RES (1)..(1): Any amino acid
XLEIKAYYAGHVLGAAMFQIKVGSESVVYTSCLD

SEQ ID NO: 17645 - protein, 92 aa, Homo sapiens
  Payload ID: 3553
  Gene Symbol: CPSF3L
  Gene Name: cleavage and polyadenylation specific factor 3-like
  ENSP ID: ENSP00000431952
MPEIRVTPLGACPVLSWNLVLPPGRGSRAPSSTDTRTGFHVLPHGGPARTWAEAASWSPLRARMSCWTVECTWASMTTDASLTSPTSPRTAA

SEQ ID NO: 17646 - protein, 249 aa, Homo sapiens
  Payload ID: 3553
  Gene Symbol: CPSF3L
  Gene Name: cleavage and polyadenylation specific factor 3-like
  ENSP ID: ENSP00000432009
MPEIRVTPLGACPVLSWNLVLPPGRGSRAPSSTDTRTGFHVLPHGVSASSEGAPRPGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLIT

SEQ ID NO: 17647 - protein, 278 aa, Homo sapiens
  Payload ID: 3553
  Gene Symbol: CPSF3L
  Gene Name: cleavage and polyadenylation specific factor 3-like
  ENSP ID: ENSP00000432777
MPEIRVTPLGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKGAHEPEGAHLLLHGADREGQPLLQAVHPLDQPEDPQDFRAEEHV

SEQ ID NO: 17648 - protein, 54 aa, Homo sapiens
  Payload ID: 3553
  Gene Symbol: CPSF3L
  Gene Name: cleavage and polyadenylation specific factor 3-like
  ENSP ID: ENSP00000433264
KDCMKKVVAVHLHQTVQVDDELEIKAYYAGHVLGAAMFQIKVGSESVVYTSCLD

SEQ ID NO: 17649 - protein, 56 aa, Homo sapiens
  Payload ID: 3553
  Gene Symbol: CPSF3L
  Gene Name: cleavage and polyadenylation specific factor 3-like
  ENSP ID: ENSP00000433733
MPEIRVTPLGAGQDVGRSCILVSIAGKNVMLDCGMHMGFNDDPGVLVPPAGWECPA

SEQ ID NO: 17650 - protein, 62 aa, Homo sapiens
  Payload ID: 3553
  Gene Symbol: CPSF3L
  Gene Name: cleavage and polyadenylation specific factor 3-like
  ENSP ID: ENSP00000433930
MPEIRVTPLGACPVLSWNLVLPPGRGSRAPSSTDTRTGFHVLPHGVSASSEGAPRPGVDTVL

SEQ ID NO: 17651 - protein, 55 aa, Homo sapiens
  Payload ID: 3553
  Gene Symbol: CPSF3L
  Gene Name: cleavage and polyadenylation specific factor 3-like
  ENSP ID: ENSP00000434782
  MOD_RES (1)..(1): Any amino acid
XEIRVTPLGAGQDVGRSCILVSIAGKNVMLDCGMHMGFNDDPGVLVPPAGWECPA

SEQ ID NO: 17652 - protein, 109 aa, Homo sapiens
  Payload ID: 3553
  Gene Symbol: CPSF3L
  Gene Name: cleavage and polyadenylation specific factor 3-like
  ENSP ID: ENSP00000434790
MIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGG

SEQ ID NO: 17653 - protein, 81 aa, Homo sapiens
  Payload ID: 3553
  Gene Symbol: CPSF3L
  Gene Name: cleavage and polyadenylation specific factor 3-like
  ENSP ID: ENSP00000435418
MPEIRVTPLGAGQDVGRSCILVSIAGKNVMLDCGMHMGFNDDRRFPDFSYITQNGRLTDFLDCVIIRPSAPSCWRTTARSP

SEQ ID NO: 17654 - protein, 140 aa, Homo sapiens
  Payload ID: 3553
  Gene Symbol: CPSF3L
  Gene Name: cleavage and polyadenylation specific factor 3-like
  ENSP ID: ENSP00000435772
MPEIRVTPLVGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLH

SEQ ID NO: 17655 - protein, 64 aa, Homo sapiens
  Payload ID: 3553
  Gene Symbol: CPSF3L
  Gene Name: cleavage and polyadenylation specific factor 3-like
  ENSP ID: ENSP00000436396
  MOD_RES (1)..(1): Any amino acid
XTMPEIRVTPLGACPVLSWNLVLPPGRGSRAPSSTDTRTGFHVLPHGVSASSEGAPRPGVDTVL

SEQ ID NO: 17656 - protein, 209 aa, Homo sapiens
  Payload ID: 3553
  Gene Symbol: CPSF3L
  Gene Name: cleavage and polyadenylation specific factor 3-like
  ENSP ID: ENSP00000436743
MCGAGFGHFEWLAGGGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITE

SEQ ID NO: 17657 - protein, 167 aa, Homo sapiens
  Payload ID: 3553
  Gene Symbol: CPSF3L
  Gene Name: cleavage and polyadenylation specific factor 3-like
  ENSP ID: ENSP00000436824
MPEIRVTPLGACPVLSWNLVLPPGRGSRAPSSTDTRTGFHVLPHGPLGCGPVILMCGAGFGHFEWLAGGGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDY

SEQ ID NO: 17658 - protein, 571 aa, Homo sapiens
  Payload ID: 3553
  Gene Symbol: CPSF3L
  Gene Name: cleavage and polyadenylation specific factor 3-like
  Uniprot ID: Q5TA45
  ENSP ID: ENSP00000444672
MLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 17659 - protein, 606 aa, Homo sapiens
  Payload ID: 3553
  Gene Symbol: CPSF3L
  Gene Name: cleavage and polyadenylation specific factor 3-like
  Uniprot ID: Q5TA45
  ENSP ID: ENSP00000445001
MCGAGFGHFEWLAGGGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 17660 - protein, 342 aa, Homo sapiens
  Payload ID: 3553
  Gene Symbol: CPSF3L
  Gene Name: cleavage and polyadenylation specific factor 3-like
  ENSP ID: ENSP00000464436
MNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 17661 - protein, 389 aa, Homo sapiens
  Payload ID: 3553
  Gene Symbol: CPSF3L
  Gene Name: cleavage and polyadenylation specific factor 3-like
  ENSP ID: ENSP00000480957
MPEIRVTPLGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 17662 - protein, 289 aa, Homo sapiens
  Payload ID: 3553
  Gene Symbol: CPSF3L
  Gene Name: cleavage and polyadenylation specific factor 3-like
  ENSP ID: ENSP00000481275
MPEIRVTPLGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQVRFPGPQLAQSLPTPTPTMPSARSTQFLEGWGLRVSPPHLTLASSTVGTPGGVSARMRVPDQTGRRPGRARAGWGYAPAYEPTRLCPSGIEMARVGQAGALRALGAARDSLELPGCCRAGRQGLEGRWASSGGCLVLGVGQGRSEG

SEQ ID NO: 17663 - protein, 502 aa, Homo sapiens
  Payload ID: 3553
  Gene Symbol: CPSF3L
  Gene Name: cleavage and polyadenylation specific factor 3-like
  ENSP ID: ENSP00000481821
MPEIRVTPLGACPVLSWNLVLPPGRGSRAPSSTDTRTGFHVLPHGVNDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 17664 - protein, 46 aa, Homo sapiens
  Payload ID: 3553
  Gene Symbol: CPSF3L
  Gene Name: cleavage and polyadenylation specific factor 3-like
  ENSP ID: ENSP00000487303
MPEIRVTPLGAGQDVGRSCILVSIAGKNVMLDCGMHMGFNDDLCLD

SEQ ID NO: 17665 - protein, 269 aa, Homo sapiens
  Payload ID: 3554
  Gene Symbol: CPSF4
  Gene Name: cleavage and polyadenylation specific factor 4, 30kDa
  Uniprot ID: O95639
  ENSP ID: ENSP00000292476
MQEIIASVDHIKFDLEIAVEQQLGAQPLPFPGMDKSGAAVCEFFLKAACGKGGMCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHPRFELPMGTTEQPPLPQQTQPPAKQSNNPPLQRSSSLIQLTSQNSSPNQQRTPQVIGVMQSQNSSAGNRGPRPLEQVTCYKCGEKGHYANRCTKGHLAFLSGQ

SEQ ID NO: 17666 - protein, 229 aa, Homo sapiens
  Payload ID: 3554
  Gene Symbol: CPSF4
  Gene Name: cleavage and polyadenylation specific factor 4, 30kDa
  ENSP ID: ENSP00000392584
TESGAAVCEFFLKAACGKGGMCPFRHISGEKTVVCKHWLRGLCKKGDQCEFLHEYDMTKMPECYFYSKFGECSNKECPFLHIDPESKIKDCPWYDRGFCKHALDLNCPWEPPSSPHCRSRHSLQQSREPRRSSGSCRVKTAARATGDPGHWSRSPVTSVARKDTTPTDAPKGTWPFSVDSDSSWSQLRAARGPRCWECAFNCFMRLLARLWLELARRHVGFITLRGHVC

SEQ ID NO: 17667 - protein, 244 aa, Homo sapiens
  Payload ID: 3554
  Gene Symbol: CPSF4
  Gene Name: cleavage and polyadenylation specific factor 4, 30kDa
  Uniprot ID: O95639
  ENSP ID: ENSP00000395311
MQEIIASVDHIKFDLEIAVEQQLGAQPLPFPGMDKSGAAVCEFFLKAACGKGGMCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHPRFELPMGTTEQPPLPQQTQPPAKQRTPQVIGVMQSQNSSAGNRGPRPLEQVTCYKCGEKGHYANRCTKGHLAFLSGQ

SEQ ID NO: 17668 - protein, 211 aa, Homo sapiens
  Payload ID: 3554
  Gene Symbol: CPSF4
  Gene Name: cleavage and polyadenylation specific factor 4, 30kDa
  ENSP ID: ENSP00000396060
MQEIIASVDHIKFDLEIAVEQQLGAQPLPFPGMDKSGAAVCEFFLKAACGKGGMCPFRHISGEKTVVCKHWLRGLCKKGDQCEFLHEYDMTKMPECYFYSKFGPLCRHRHTRRVICVNYLVGFCPEGPSCKFMHPRFELPMGTTEQPPLPQQTQPPAKRTPQVIGVMQSQNSSAGNRGPRPLEQVTCYKCGEKGHYANRCTKGHLAFLSGQ

SEQ ID NO: 17669 - protein, 112 aa, Homo sapiens
  Payload ID: 3554
  Gene Symbol: CPSF4
  Gene Name: cleavage and polyadenylation specific factor 4, 30kDa
  ENSP ID: ENSP00000401150
MCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFM

SEQ ID NO: 17670 - protein, 44 aa, Homo sapiens
  Payload ID: 3554
  Gene Symbol: CPSF4
  Gene Name: cleavage and polyadenylation specific factor 4, 30kDa
  ENSP ID: ENSP00000401496
MDKSGAAVCEFFLKAACGKEETGFHRDSQDGLRASQDGLDLLTL

SEQ ID NO: 17671 - protein, 191 aa, Homo sapiens
  Payload ID: 3554
  Gene Symbol: CPSF4
  Gene Name: cleavage and polyadenylation specific factor 4, 30kDa
  ENSP ID: ENSP00000402224
MCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHPRFELPMGTTEQPPLPQQTQPPAKQRTPQVIGVMQSQNSSAGNRGPRPLEQVTCYKCGEKGHYANRCTKGHLAFLSGQ

SEQ ID NO: 17672 - protein, 193 aa, Homo sapiens
  Payload ID: 3554
  Gene Symbol: CPSF4
  Gene Name: cleavage and polyadenylation specific factor 4, 30kDa
  ENSP ID: ENSP00000415188
  MOD_RES (1)..(1): Any amino acid
XKIKDCPWYDRGFCKHGPLCRHRHTRRVICVNYLVGFCPEGPSCKFMHPRFELPMGTTEQPPLPQQTQPPAKQSNNPPLQRSSSLIQLTSQNSSPNQQRTPQVIGVMQSQNSSAGNRGPRPLEQVTCYKCCCLSLLFPHFLLFPVWRERTLRQQMHQRALGLSQWTVTAAGASSEQPGGPAVGSVHLTVSCAC

SEQ ID NO: 17673 - protein, 179 aa, Homo sapiens
  Payload ID: 3555
  Gene Symbol: CPSF4L
  Gene Name: cleavage and polyadenylation specific factor 4-like
  Uniprot ID: A6NMK7
  ENSP ID: ENSP00000343900
MQEVIAGLERFTFAFEKDVEMQKGTGLLPFQGMDKSASAVCNFFTKGLCEKGKLCPFRHDRGEKMVVCKHWLRGLCKKGDHCKFLHQYDLTRMPECYFYSKFGDCSNKECSFLHVKPAFKSQDCPWYDQGFCKDGPLCKYRHVPRIMCLNYLVGFCPEGPKCQFAQKIREFKLLPGSKI

SEQ ID NO: 17674 - protein, 152 aa, Homo sapiens
  Payload ID: 3555
  Gene Symbol: CPSF4L
  Gene Name: cleavage and polyadenylation specific factor 4-like
  ENSP ID: ENSP00000380788
MVVCKHWLRGLCKKGDHCKFLHQYDLTRMPECYFYSKFGDCSNKECSFLHVKPAFKSQDCPWYDQGFCKDAGPLCKYRHVPRIMCLNYLVGFCPEGPKCQFAHCSLPAGPGIQHLLFLLWKLGNPHPQQSACSPAWGSGVKGRACATGPLCQ

SEQ ID NO: 17675 - protein, 588 aa, Homo sapiens
  Payload ID: 3556
  Gene Symbol: CPSF6
  Gene Name: cleavage and polyadenylation specific factor 6, 68kDa
  Uniprot ID: Q16630
  ENSP ID: ENSP00000266679
MADGVDHIDIYADVGEEFNQEAEYGGHDQIDLYDDVISPSANNGDAPEDRDYMDTLPPTVGDDVGKGAAPNVVYTYTGKRIALYIGNLTWWTTDEDLTEAVHSLGVNDILEIKFFENRANGQSKGFALVGVGSEASSKKLMDLLPKRELHGQNPVVTPCNKQFLSQFEMQSRKTTQSGQMSGEGKAGPPGGSSRAAFPQGGRGRGRFPGAVPGGDRFPGPAGPGGPPPPFPGNLIKHLVKGTRPLFLETRIPWHMGHSIEEIPIFGLKAGQTPPRPPLGPPGPPGPPGPPPPGQVLPPPLAGPPNRGDRPPPPVLFPGQPFGQPPLGPLPPGPPPPVPGYGPPPGPPPPQQGPPPPPGPFPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 17676 - protein, 478 aa, Homo sapiens
  Payload ID: 3556
  Gene Symbol: CPSF6
  Gene Name: cleavage and polyadenylation specific factor 6, 68kDa
  ENSP ID: ENSP00000391437
MADGVDHIDIYADVGEEFNQEAEYGGHDQIDLYDDVISPSANNGDAPEDRDYMDTLPPTVGDDVGKGAAPNVVYTYTGKRIALYIGNLTWWTTDEDLTEAVHSLGVNDILEIKFFENRANGQSKGFALVGVGSEASSKKLMDLLPKRELHGQNPVVTPCNKQFLSQFEMQSRKTTQSGQMSGEGKAGPPGAGPPNRGDRPPPPVLFPGQPFGQPPLGPLPPGPPPPVPGYGPPPGPPPPQQGPPPPPGPFPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 17677 - protein, 551 aa, Homo sapiens
  Payload ID: 3556
  Gene Symbol: CPSF6
  Gene Name: cleavage and polyadenylation specific factor 6, 68kDa
  Uniprot ID: Q16630
  ENSP ID: ENSP00000391774
MADGVDHIDIYADVGEEFNQEAEYGGHDQIDLYDDVISPSANNGDAPEDRDYMDTLPPTVGDDVGKGAAPNVVYTYTGKRIALYIGNLTWWTTDEDLTEAVHSLGVNDILEIKFFENRANGQSKGFALVGVGSEASSKKLMDLLPKRELHGQNPVVTPCNKQFLSQFEMQSRKTTQSGQMSGEGKAGPPGGSSRAAFPQGGRGRGRFPGAVPGGDRFPGPAGPGGPPPPFPAGQTPPRPPLGPPGPPGPPGPPPPGQVLPPPLAGPPNRGDRPPPPVLFPGQPFGQPPLGPLPPGPPPPVPGYGPPPGPPPPQQGPPPPPGPFPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 17678 - protein, 107 aa, Homo sapiens
  Payload ID: 3556
  Gene Symbol: CPSF6
  Gene Name: cleavage and polyadenylation specific factor 6, 68kDa
  ENSP ID: ENSP00000446670
MADGVDHIDIYADVGEEFNQEAEYGGHDQIDLYDDVISPSANNGDAPEDRDYMDTLPPTVGDDVGKGAAPNVVYTYTGKRIALYIGNLTWGETEFAKLCHPGWSAVV

SEQ ID NO: 17679 - protein, 56 aa, Homo sapiens
  Payload ID: 3556
  Gene Symbol: CPSF6
  Gene Name: cleavage and polyadenylation specific factor 6, 68kDa
  ENSP ID: ENSP00000450206
MADGVDHIDIYADVGEEFNQEAEYEREAENERGTGIVTETVTESVTESANIVIVRS

SEQ ID NO: 17680 - protein, 514 aa, Homo sapiens
  Payload ID: 3557
  Gene Symbol: CPSF7
  Gene Name: cleavage and polyadenylation specific factor 7, 59kDa
  Uniprot ID: Q8N684
  ENSP ID: ENSP00000345412
MGRPESAGGGSRGPFEGGGRARRAGGIFLTLSILRTRDLPSGAMSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRECVRVPRGGIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 17681 - protein, 471 aa, Homo sapiens
  Payload ID: 3557
  Gene Symbol: CPSF7
  Gene Name: cleavage and polyadenylation specific factor 7, 59kDa
  Uniprot ID: Q8N684
  ENSP ID: ENSP00000378352
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRECVRVPRGGIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 17682 - protein, 145 aa, Homo sapiens
  Payload ID: 3557
  Gene Symbol: CPSF7
  Gene Name: cleavage and polyadenylation specific factor 7, 59kDa
  ENSP ID: ENSP00000391359
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELL

SEQ ID NO: 17683 - protein, 143 aa, Homo sapiens
  Payload ID: 3557
  Gene Symbol: CPSF7
  Gene Name: cleavage and polyadenylation specific factor 7, 59kDa
  ENSP ID: ENSP00000392400
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLE

SEQ ID NO: 17684 - protein, 204 aa, Homo sapiens
  Payload ID: 3557
  Gene Symbol: CPSF7
  Gene Name: cleavage and polyadenylation specific factor 7, 59kDa
  ENSP ID: ENSP00000393828
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRIPPRAHSRDSSDSADGRATPSENLVPSSA

SEQ ID NO: 17685 - protein, 462 aa, Homo sapiens
  Payload ID: 3557
  Gene Symbol: CPSF7
  Gene Name: cleavage and polyadenylation specific factor 7, 59kDa
  Uniprot ID: Q8N684
  ENSP ID: ENSP00000397203
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFPPPNATVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDDYFQERNREHERHRDRERDRHH

SEQ ID NO: 17686 - protein, 462 aa, Homo sapiens; identical to SEQ ID NO: 17685
  Payload ID: 3557
  Gene Symbol: CPSF7
  Gene Name: cleavage and polyadenylation specific factor 7, 59kDa
  Uniprot ID: Q8N684
  ENSP ID: ENSP00000407394

SEQ ID NO: 17687 - protein, 138 aa, Homo sapiens
  Payload ID: 3557
  Gene Symbol: CPSF7
  Gene Name: cleavage and polyadenylation specific factor 7, 59kDa
  ENSP ID: ENSP00000414295
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSV

SEQ ID NO: 17688 - protein, 101 aa, Homo sapiens
  Payload ID: 3557
  Gene Symbol: CPSF7
  Gene Name: cleavage and polyadenylation specific factor 7, 59kDa
  ENSP ID: ENSP00000437467
MSEGVDLIDIYADEEFNQDPEFNNTDQIDLYDDVLTATSQPSDDRSSSTEPPPPVRQEPSPKPNNKTPAILYTYSGLRNRRAAVYVGSFSWVGLISERELS

SEQ ID NO: 17689 - protein, 219 aa, Homo sapiens
  Payload ID: 3557
  Gene Symbol: CPSF7
  Gene Name: cleavage and polyadenylation specific factor 7, 59kDa
  ENSP ID: ENSP00000437531
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRIPPRAHSRDSSDSADGRATPSENLVPSSARVDKPPSVLPYFNRP

SEQ ID NO: 17690 - protein, 101 aa, Homo sapiens
  Payload ID: 3557
  Gene Symbol: CPSF7
  Gene Name: cleavage and polyadenylation specific factor 7, 59kDa
  ENSP ID: ENSP00000437768
MSEGVDLIDIYADEEFNQDPEFNNTDQIDLYDDVLTATSQPSDDRSSSTEPPPPVRQEPSPKPNNKTPAILYTYSGLRNRRAAVYVGSFSWQGHLRDEISE

SEQ ID NO: 17691 - protein, 374 aa, Homo sapiens
  Payload ID: 3557
  Gene Symbol: CPSF7
  Gene Name: cleavage and polyadenylation specific factor 7, 59kDa
  ENSP ID: ENSP00000437860
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRIPPRAHSRDSSDSADGRATPSENLVPSSARVDKPPSVLPYFNRPPSALPLMVGPPPDTYMKASAPYNHHGSRDSGPPPSTVSEAEFEDIMKRNRAISSSAISKAVSGASAGDYSDAIETLLTAIAVIKQSRVANDERCRVLISSLKDCLHGIEAKSYSVGASGSSSRKRHRSRERSPSRSRESSRRHRDLLHNEDRHDD

SEQ ID NO: 17692 - protein, 288 aa, Homo sapiens
  Payload ID: 3557
  Gene Symbol: CPSF7
  Gene Name: cleavage and polyadenylation specific factor 7, 59kDa
  ENSP ID: ENSP00000438381
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVIRSIGVYDVVELKFAENRANGQSKGYAEVVVASENSVHKLLELLPGKVLNGEKVDVRPATRQNLSQFEAQARKRIPPRAHSRDSSDSADGRATPSENLVPSSARVDKPPSVLPYFNRPPSALPLMGLPPPPIPPPPPLSSSFGVPPPPPGIHYQHLMPPPPRLPPHLAVPPPGAIPPALHLNPAFFP

SEQ ID NO: 17693 - protein, 102 aa, Homo sapiens
  Payload ID: 3557
  Gene Symbol: CPSF7
  Gene Name: cleavage and polyadenylation specific factor 7, 59kDa
  ENSP ID: ENSP00000440414
MSEGVDLIDIYADEEFNQDPEFNNTDQIDLYDDVLTATSQPSDDRSSSTEPPPPVRQEPSPKPNNKTPAILYTYSGLRNRRAAVYVGSFSWWTTDQQLIQVC

SEQ ID NO: 17694 - protein, 101 aa, Homo sapiens; identical to SEQ ID NO: 17688
  Payload ID: 3557
  Gene Symbol: CPSF7
  Gene Name: cleavage and polyadenylation specific factor 7, 59kDa
  ENSP ID: ENSP00000442819

SEQ ID NO: 17695 - protein, 93 aa, Homo sapiens
  Payload ID: 3557
  Gene Symbol: CPSF7
  Gene Name: cleavage and polyadenylation specific factor 7, 59kDa
  ENSP ID: ENSP00000443504
MSEGVDLIDIYADEEFNQDPEFNNTDQIDLYDDVLTATSQPSDDRSSSTEPPPPVRQEPSPKPNNKTPAILYTYSGLRNRRAAVYVGSFSWVC

SEQ ID NO: 17696 - protein, 100 aa, Homo sapiens
  Payload ID: 3557
  Gene Symbol: CPSF7
  Gene Name: cleavage and polyadenylation specific factor 7, 59kDa
  ENSP ID: ENSP00000446193
MSEGVDLIDIYADEEFNQDPEFNNTDQIDLYDDVLTATSQPSDDRSSSTEPPPPVRQEPSPKPNNKTPAILYTYSGLRNRRAAVYVGSFSWGHLRDEISE

SEQ ID NO: 17697 - protein, 98 aa, Homo sapiens
  Payload ID: 3557
  Gene Symbol: CPSF7
  Gene Name: cleavage and polyadenylation specific factor 7, 59kDa
  ENSP ID: ENSP00000446330
MSEGVDLIDIYADEEFNQDPEFNNTDQIDLYDDVLTATSQPSDDRSSSTEPPPPVRQEPSPKPNNKTPAILYTYSGLRNRRAAVYVGSFSWESMMWWS

SEQ ID NO: 17698 - protein, 101 aa, Homo sapiens; identical to SEQ ID NO: 17688
  Payload ID: 3557
  Gene Symbol: CPSF7
  Gene Name: cleavage and polyadenylation specific factor 7, 59kDa
  ENSP ID: ENSP00000487286

SEQ ID NO: 17699 - protein, 431 aa, Homo sapiens
  Payload ID: 3558
  Gene Symbol: CSTF1
  Gene Name: cleavage stimulation factor, 3' pre-RNA, subunit 1, 50kDa
  Uniprot ID: Q05048
  ENSP ID: ENSP00000217109
MYRTKVGLKDRQQLYKLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLAKSAMPIEVMMNETAQQNMENHPVIRTLYDHVDEVTCLAFHPTEQILASGSRDYTLKLFDYSKPSAKRAFKYIQEAEMLRSISFHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYTGAGLSGRQVHRTQAVFNHTEDYVLLPDERTISLCCWDSRTAERRNLLSLGHNNIVRCIVHSPTNPGFMTCSDDFRARFWYRRSTTD

SEQ ID NO: 17700 - protein, 345 aa, Homo sapiens
  Payload ID: 3558
  Gene Symbol: CSTF1
  Gene Name: cleavage stimulation factor, 3' pre-RNA, subunit 1, 50kDa
  ENSP ID: ENSP00000387968
MYRTKVGLKDRQQLYKLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLAKSAMPIEVMMNETAQQNMENHPVIRTLYDHVDEVTCLAFHPTEQILASGSRDYTLKLFDYSKPSAKRAFKYIQEAEMLRSISFHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYT

SEQ ID NO: 17701 - protein, 142 aa, Homo sapiens
  Payload ID: 3558
  Gene Symbol: CSTF1
  Gene Name: cleavage stimulation factor, 3' pre-RNA, subunit 1, 50kDa
  ENSP ID: ENSP00000405171
MYRTKVGLKDRQQLYKLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLA

SEQ ID NO: 17702 - protein, 345 aa, Homo sapiens; identical to SEQ ID NO: 17700
  Payload ID: 3558
  Gene Symbol: CSTF1
  Gene Name: cleavage stimulation factor, 3' pre-RNA, subunit 1, 50kDa
  ENSP ID: ENSP00000409035

SEQ ID NO: 17703 - protein, 59 aa, Homo sapiens
  Payload ID: 3558
  Gene Symbol: CSTF1
  Gene Name: cleavage stimulation factor, 3' pre-RNA, subunit 1, 50kDa
  ENSP ID: ENSP00000477958
MYRTKVGLKDRQQLYKLIISQLLYDGYISIANGLINEIKPQSVCAPSEQLLHLIKLGRL

SEQ ID NO: 17704 - protein, 59 aa, Homo sapiens; identical to SEQ ID NO: 17703
  Payload ID: 3558
  Gene Symbol: CSTF1
  Gene Name: cleavage stimulation factor, 3' pre-RNA, subunit 1, 50kDa
  ENSP ID: ENSP00000479273

SEQ ID NO: 17705 - protein, 577 aa, Homo sapiens
  Payload ID: 3559
  Gene Symbol: CSTF2
  Gene Name: cleavage stimulation factor, 3' pre-RNA, subunit 2, 64kDa
  Uniprot ID: P33240
  ENSP ID: ENSP00000362063
MAGLTVRDPAVDRSLRSVFVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKLCVQNSPQEARNMLLQNPQLAYALLQAQVVMRIVDPEIALKILHRQTNIPTLIAGNPQPVHGAGPGSGSNVSMNQQNPQAPQAQSLGGMHVNGAPPLMQASMQGGVPAPGQMPAAVTGPGPGSLAPGGGMQAQVGMPGSGPVSMERGQVPMQDPRAAMQRGSLPANVPTPRGLLGDAPNDPRGGTLLSVTGEVEPRGYLGPPHQGPPMHHVPGHESRGPPPHELRGGPLPEPRPLMAEPRGPMLDQRGPPLDGRGGRDPRGIDARGMEARAMEARGLDARGLEARAMEARAMEARAMEARAMEARAMEVRGMEARGMDTRGPVPGPRGPIPSGMQGPSPINMGAVVPQGSRQVPVMQGTGMQGASIQGGSQPGGFSPGQNQVTPQDHEKAALIMQVLQLTADQIAMLPPEQRQSILILKEQIQKSTGAP

SEQ ID NO: 17706 - protein, 597 aa, Homo sapiens
  Payload ID: 3559
  Gene Symbol: CSTF2
  Gene Name: cleavage stimulation factor, 3' pre-RNA, subunit 2, 64kDa
  ENSP ID: ENSP00000387996
MAGLTVRDPAVDRSLRSVFVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKLCVQNSPQEARNMLLQNPQLAYALLQAQVVMRIVDPEIALKILHRQTNIPTLIAGNPQPVHGAGPGSGSNVSMNQQNPQAPQAQSLGGMHVNGAPPLMQASMQGGVPAPGQMPAAVTGPGPGSLAPGGGMQAQVGMPGSGPVSMERGQGTLQHSPVGPAGPASIERVQVPMQDPRAAMQRGSLPANVPTPRGLLGDAPNDPRGGTLLSVTGEVEPRGYLGPPHQGPPMHHVPGHESRGPPPHELRGGPLPEPRPLMAEPRGPMLDQRGPPLDGRGGRDPRGIDARGMEARAMEARGLDARGLEARAMEARAMEARAMEARAMEARAMEVRGMEARGMDTRGPVPGPRGPIPSGMQGPSPINMGAVVPQGSRQVPVMQGTGMQGASIQGGSQPGGFSPGQNQVTPQDHEKAALIMQVLQLTADQIAMLPPEQRQSILILKEQIQKSTGAP

SEQ ID NO: 17707 - protein, 225 aa, Homo sapiens
  Payload ID: 3559
  Gene Symbol: CSTF2
  Gene Name: cleavage stimulation factor, 3' pre-RNA, subunit 2, 64kDa
  ENSP ID: ENSP00000415705
MSKEIFPFCRVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKLCVQNSPQEARNMLLQNPQLAYALLQAQVVMRIVDPEIALKILHRQTNIPTLIAGNPQPVHGAGPGSGSNVSMNQQNPQAPQAQSL

SEQ ID NO: 17708 - protein, 438 aa, Homo sapiens
  Payload ID: 3559
  Gene Symbol: CSTF2
  Gene Name: cleavage stimulation factor, 3' pre-RNA, subunit 2, 64kDa
  ENSP ID: ENSP00000432060
MAGLTVRDPAVDRSLRSVFVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKLCVQNSPQEARNMLLQNPQLAYALLQAQVVMRIVDPEIALKILHRQTNIPTLIAGNPQPVHGAGPGSGSNVSMNQQNPQAPQAQSLGGVPAPGQMPAAVTGPGPGSLAPGGGMQAQVGMPGSGPVSMERGQVPMQDPRAAMQRGSLPANVPTPRGLLGDAPNDPRGGTLLSVTGEVEPRGYLGPPHQGPPMHHVPGHESRGPPPHELRGGPLPEPRPLMAEPRGPMLDQRGPPLDGRGGRDPRGIDARGMEARAMEARGLDARGLEARPSHAGNRNARSKYTGWKPAWRL

SEQ ID NO: 17709 - protein, 616 aa, Homo sapiens
  Payload ID: 3560
  Gene Symbol: CSTF2T
  Gene Name: cleavage stimulation factor, 3' pre-RNA, subunit 2, 64kDa, tau variant
  Uniprot ID: Q9H0L4
  ENSP ID: ENSP00000332444
MSSLAVRDPAMDRSLRSVFVGNIPYEATEEQLKDIFSEVGSVVSFRLVYDRETGKPKGYGFCEYQDQETALSAMRNLNGREFSGRALRVDNAASEKNKEELKSLGPAAPIIDSPYGDPIDPEDAPESITRAVASLPPEQMFELMKQMKLCVQNSHQEARNMLLQNPQLAYALLQAQVVMRIMDPEIALKILHRKIHVTPLIPGKSQSVSVSGPGPGPGPGLCPGPNVLLNQQNPPAPQPQHLARRPVKDIPPLMQTPIQGGIPAPGPIPAAVPGAGPGSLTPGGAMQPQLGMPGVGPVPLERGQVQMSDPRAPIPRGPVTPGGLPPRGLLGDAPNDPRGGTLLSVTGEVEPRGYLGPPHQGPPMHHASGHDTRGPSSHEMRGGPLGDPRLLIGEPRGPMIDQRGLPMDGRGGRDSRAMETRAMETEVLETRVMERRGMETCAMETRGMEARGMDARGLEMRGPVPSSRGPMTGGIQGPGPINIGAGGPPQGPRQVPGISGVGNPGAGMQGTGIQGTGMQGAGIQGGGMQGAGIQGVSIQGGGIQGGGIQGASKQGGSQPSSFSPGQSQVTPQDQEKAALIMQVLQLTADQIAMLPPEQRQSILILKEQIQKSTGAS

SEQ ID NO: 17710 - protein, 717 aa, Homo sapiens
  Payload ID: 3561
  Gene Symbol: CSTF3
  Gene Name: cleavage stimulation factor, 3' pre-RNA, subunit 3, 77kDa
  Uniprot ID: Q12996
  ENSP ID: ENSP00000315791
MSGDGATEQAAEYVPEKVKKAEKKLEENPYDLDAWSILIREAQNQPIDKARKTYERLVAQFPSSGRFWKLYIEAEIKAKNYDKVEKLFQRCLMKVLHIDLWKCYLSYVRETKGKLPSYKEKMAQAYDFALDKIGMEIMSYQIWVDYINFLKGVEAVGSYAENQRITAVRRVYQRGCVNPMINIEQLWRDYNKYEEGINIHLAKKMIEDRSRDYMNARRVAKEYETVMKGLDRNAPSVPPQNTPQEAQQVDMWKKYIQWEKSNPLRTEDQTLITKRVMFAYEQCLLVLGHHPDIWYEAAQYLEQSSKLLAEKGDMNNAKLFSDEAANIYERAISTLLKKNMLLYFAYADYEESRMKYEKVHSIYNRLLAIEDIDPTLVYIQYMKFARRAEGIKSGRMIFKKAREDTRTRHHVYVTAALMEYYCSKDKSVAFKIFELGLKKYGDIPEYVLAYIDYLSHLNEDNNTRVLFERVLTSGSLPPEKSGEIWARFLAFESNIGDLASILKVEKRRFTAFKEEYEGKETALLVDRYKFMDLYPCSASELKALGYKDVSRAKLAAIIPDPVVAPSIVPVLKDEVDRKPEYPKPDTQQMIPFQPRHLAPPGLHPVPGGVFPVPPAAVVLMKLLPPPICFQGPFVQVDELMEIFRRCKIPNTVEEAVRIITGGAPELAVEGNGPVESNAVLTKAVKRPNEDSDEDEEKGAVVPPVHDIYRARQQKRIR

SEQ ID NO: 17711 - protein, 103 aa, Homo sapiens
  Payload ID: 3561
  Gene Symbol: CSTF3
  Gene Name: cleavage stimulation factor, 3' pre-RNA, subunit 3, 77kDa
  Uniprot ID: Q12996
  ENSP ID: ENSP00000388711
MSGDGATEQAAEYVPEKVKKAEKKLEENPYDLDAWSILIREAQNQPIDKARKTYERLVAQFPSSGRFWKLYIEAEVTILFYFFLYQYCSIHCSDRKQVRNIAN

SEQ ID NO: 17712 - protein, 44 aa, Homo sapiens
  Payload ID: 3561
  Gene Symbol: CSTF3
  Gene Name: cleavage stimulation factor, 3' pre-RNA, subunit 3, 77kDa
  Uniprot ID: Q12996
  ENSP ID: ENSP00000393064
MSGDGATEQAAEYVPEKVKKAEKKLEENPYDLDAWSILIREAQV

SEQ ID NO: 17713 - protein, 185 aa, Homo sapiens
  Payload ID: 3561
  Gene Symbol: CSTF3
  Gene Name: cleavage stimulation factor, 3' pre-RNA, subunit 3, 77kDa
  ENSP ID: ENSP00000431355
MSGDGATEQVETRSHCVSQAGLELLDLSDPPASAFQTVGLQAAEYVPEKVKKAEKKLEENPYDLDAWSILIREAQNQPIDKARKTYERLVAQFPSSGRFWKLYIEAEIKAKNYDKVEKLFQRCLMKVLHIDLWKCYLSYVRETKGKLPSYKEKMAQAYDFALDKIGMEIMSYQIWVDYINFLKGV

SEQ ID NO: 17714 - protein, 61 aa, Homo sapiens
  Payload ID: 3561
  Gene Symbol: CSTF3
  Gene Name: cleavage stimulation factor, 3' pre-RNA, subunit 3, 77kDa
  ENSP ID: ENSP00000431903
MSGDGATEQAAEYVPEKVKKAEKKLEENPYDLDAWSILIREAQNQPIDKARKTYERLVAQF

SEQ ID NO: 17715 - protein, 52 aa, Homo sapiens
  Payload ID: 3561
  Gene Symbol: CSTF3
  Gene Name: cleavage stimulation factor, 3' pre-RNA, subunit 3, 77kDa
  ENSP ID: ENSP00000434753
MSGDGATEQTGSGSVTQARVQWRQSQFPATSPSRAQAIPPQLPKQLSMSQRR

SEQ ID NO: 17716 - protein, 91 aa, Homo sapiens
  Payload ID: 3561
  Gene Symbol: CSTF3
  Gene Name: cleavage stimulation factor, 3' pre-RNA, subunit 3, 77kDa
  ENSP ID: ENSP00000435138
  MOD_RES (1)..(1): Any amino acid
XCFQGPFVQVDELMEIFRRCKIPNTVEEAVRIITGGAPELAVEGNGPVESNAVLTKAVKRPNEDSDEDEEKGAVVPPVHDIYRARQQKRIR

SEQ ID NO: 17717 - protein, 669 aa, Homo sapiens
  Payload ID: 3562
  Gene Symbol: CLPTM1
  Gene Name: cleft lip and palate associated transmembrane protein 1
  Uniprot ID: O96005
  ENSP ID: ENSP00000336994
MAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQEAPPKPAEDKKKD

SEQ ID NO: 17718 - protein, 655 aa, Homo sapiens
  Payload ID: 3562
  Gene Symbol: CLPTM1
  Gene Name: cleft lip and palate associated transmembrane protein 1
  Uniprot ID: O96005
  ENSP ID: ENSP00000442011
MSRKAHITEKVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQEAPPKPAEDKKKD

SEQ ID NO: 17719 - protein, 567 aa, Homo sapiens
  Payload ID: 3562
  Gene Symbol: CLPTM1
  Gene Name: cleft lip and palate associated transmembrane protein 1
  Uniprot ID: O96005
  ENSP ID: ENSP00000443192
MNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQEAPPKPAEDKKKD

SEQ ID NO: 17720 - protein, 152 aa, Homo sapiens
  Payload ID: 3562
  Gene Symbol: CLPTM1
  Gene Name: cleft lip and palate associated transmembrane protein 1
  ENSP ID: ENSP00000464985
PWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDASSP

SEQ ID NO: 17721 - protein, 18 aa, Homo sapiens
  Payload ID: 3562
  Gene Symbol: CLPTM1
  Gene Name: cleft lip and palate associated transmembrane protein 1
  ENSP ID: ENSP00000465731
MNLHVYISEHEHFTDFNA

SEQ ID NO: 17722 - protein, 171 aa, Homo sapiens
  Payload ID: 3562
  Gene Symbol: CLPTM1
  Gene Name: cleft lip and palate associated transmembrane protein 1
  ENSP ID: ENSP00000467927
MAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMSVQQNGSIYIHVYFTKSGFHPDPRQKALYRRLATVHMSRMINKYKRRRFQKTKNLLTGETEADPEMIK

SEQ ID NO: 17723 - protein, 209 aa, Homo sapiens
  Payload ID: 3562
  Gene Symbol: CLPTM1
  Gene Name: cleft lip and palate associated transmembrane protein 1
  ENSP ID: ENSP00000468310
YKLKSVAHLPWRMLTYKALNTFIDDLFAFVIKMPVMYRIGCLRDGPPGCGRASPTSHCLPPLSRCGFLHLPLPTVDLPRRPHPSQRVWHEWRRPHSCRPRGRGSHSSRGPHAHTCTHHDHRHQGGGLHVPAHQAHPGGQLCQRAPGSPSKASRGQEKGLVETGPHLLRLLATTTPASRPPRLPSLSPFPWTDQAGAVGGPPQVRAQRVM

SEQ ID NO: 17724 - protein, 674 aa, Homo sapiens
  Payload ID: 3563
  Gene Symbol: CLASRP
  Gene Name: CLK4-associating serine/arginine rich protein
  ENSP ID: ENSP00000221455
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKERERREKEREEWERQYSRQSRSPSPRYSREYSSSRRRSRSRSRSPHYRH

SEQ ID NO: 17725 - protein, 594 aa, Homo sapiens
  Payload ID: 3563
  Gene Symbol: CLASRP
  Gene Name: CLK4-associating serine/arginine rich protein
  Uniprot ID: Q8N2M8
  ENSP ID: ENSP00000375814
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKVTQADASGEAETEDAEGAEQAVQGG

SEQ ID NO: 17726 - protein, 612 aa, Homo sapiens
  Payload ID: 3563
  Gene Symbol: CLASRP
  Gene Name: CLK4-associating serine/arginine rich protein
  Uniprot ID: Q8N2M8
  ENSP ID: ENSP00000375815
MWHEARKHERKLRGMMVDYKKRAERRREYYEKIKKDPAQFLQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKERERREKEREEWERQYSRQSRSPSPRYSREYSSSRRRSRSRSRSPHYRH

SEQ ID NO: 17727 - protein, 655 aa, Homo sapiens
  Payload ID: 3563
  Gene Symbol: CLASRP
  Gene Name: CLK4-associating serine/arginine rich protein
  ENSP ID: ENSP00000438702
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKVIKADKKAAQEKMIQQEHERQEREDELRAMARKIRMKERERREKEREEWERQYSRQSRSPSPRYSREYSSSRRRSRSRSRSPHYRH

SEQ ID NO: 17728 - protein, 86 aa, Homo sapiens
  Payload ID: 3563
  Gene Symbol: CLASRP
  Gene Name: CLK4-associating serine/arginine rich protein
  ENSP ID: ENSP00000465562
MWHEARKHERKLRGMMVDYKKRAERRREYYEKIKKDPAQFLQVHGRACKVHLDSAVALAAESPVNMMPWQGDTNNMIDRFDVRAHL

SEQ ID NO: 17729 - protein, 81 aa, Homo sapiens
  Payload ID: 3563
  Gene Symbol: CLASRP
  Gene Name: CLK4-associating serine/arginine rich protein
  ENSP ID: ENSP00000465750
MWHEARKHERKLRGMMVDYKKRAERRREYYEKISQRSSACTRSTLMSCTEASRDPAKMRRRSWQRRRLPSVIPTRTARWPR

SEQ ID NO: 17730 - protein, 188 aa, Homo sapiens
  Payload ID: 3563
  Gene Symbol: CLASRP
  Gene Name: CLK4-associating serine/arginine rich protein
  ENSP ID: ENSP00000466371
KKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDETWRWTWMN

SEQ ID NO: 17731 - protein, 131 aa, Homo sapiens
  Payload ID: 3563
  Gene Symbol: CLASRP
  Gene Name: CLK4-associating serine/arginine rich protein
  ENSP ID: ENSP00000467177
PKLTPQEKLKLRMQKALNRQFKADKKAAQEKMIQQEHERQEREDELRAMARKIRMKVLEAPALPEFSVSSVPGQMLMPCLRRERERREKEREEWERQYSRQSRSPSPRYSREYSSSRRRSRSRSRSPHYRH

SEQ ID NO: 17732 - protein, 846 aa, Homo sapiens
  Payload ID: 3564
  Gene Symbol: CLOCK
  Gene Name: clock circadian regulator
  Uniprot ID: O15516
  ENSP ID: ENSP00000308741
MLFTVSCSKMSSIVDRDDSSIFDGLVEEDDKDKAKRVSRNKSEKKRRDQFNVLIKELGSMLPGNARKMDKSTVLQKSIDFLRKHKEITAQSDASEIRQDWKPTFLSNEEFTQLMLEALDGFFLAIMTDGSIIYVSESVTSLLEHLPSDLVDQSIFNFIPEGEHSEVYKILSTHLLESDSLTPEYLKSKNQLEFCCHMLRGTIDPKEPSTYEYVKFIGNFKSLNSVSSSAHNGFEGTIQRTHRPSYEDRVCFVATVRLATPQFIKEMCTVEEPNEEFTSRHSLEWKFLFLDHRAPPIIGYLPFEVLGTSGYDYYHVDDLENLAKCHEHLMQYGKGKSCYYRFLTKGQQWIWLQTHYYITYHQWNSRPEFIVCTHTVVSYAEVRAERRRELGIEESLPETAADKSQDSGSDNRINTVSLKEALERFDHSPTPSASSRSSRKSSHTAVSDPSSTPTKIPTDTSTPPRQHLPAHEKMVQRRSSFSSQSINSQSVGSSLTQPVMSQATNLPIPQGMSQFQFSAQLGAMQHLKDQLEQRTRMIEANIHRQQEELRKIQEQLQMVHGQGLQMFLQQSNPGLNFGSVQLSSGNSSNIQQLAPINMQGQVVPTNQIQSGMNTGHIGTTQHMIQQQTLQSTSTQSQQNVLSGHSQQTSLPSQTQSTLTAPLYNTMVISQPAAGSMVQIPSSMPQNSTQSAAVTTFTQDRQIRFSQGQQLVTKLVTAPVACGAVMVPSTMLMGQVVTAYPTFATQQQQSQTLSVTQQQQQQSSQEQQLTSVQQPSQAQLTQPPQQFLQTSRLLHGNPSTQLILSAAFPLQQSTFPQSHHQQHQSQQQQQLSRHRTDSLPDPSKVQPQ

SEQ ID NO: 17733 - protein, 846 aa, Homo sapiens; identical to SEQ ID NO: 17732
  Payload ID: 3564
  Gene Symbol: CLOCK
  Gene Name: clock circadian regulator
  Uniprot ID: O15516
  ENSP ID: ENSP00000370723

SEQ ID NO: 17734 - protein, 182 aa, Homo sapiens
  Payload ID: 3564
  Gene Symbol: CLOCK
  Gene Name: clock circadian regulator
  ENSP ID: ENSP00000396649
MLFTVSCSKMSSIVDRDDSSIFDGLVEEDDKDKAKRVSRNKSEKKRRDQFNVLIKELGSMLPGNARKMDKSTVLQKSIDFLRKHKEITAQSDASEIRQDWKPTFLSNEEFTQLMLEALDGFFLAIMTDGSIIYVSESVTSLLEHLPSDLVDQSIFNFIPEGEHSEVYKILSTHLLESDSLTP

SEQ ID NO: 17735 - protein, 846 aa, Homo sapiens; identical to SEQ ID NO: 17732
  Payload ID: 3564
  Gene Symbol: CLOCK
  Gene Name: clock circadian regulator
  Uniprot ID: O15516
  ENSP ID: ENSP00000426983

SEQ ID NO: 17736 - protein, 399 aa, Homo sapiens
  Payload ID: 3565
  Gene Symbol: CIPC
  Gene Name: CLOCK-interacting pacemaker
  Uniprot ID: Q9C0C6
  ENSP ID: ENSP00000355319
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVPSPVSPCHTGEKKSDSRNYLPILNSYTKIAPHPGKRGLSLGPEEKGTSGVQKKICTERLGPSLSSSEPTKAGAVPSSPSTPAPPSAKLAEDSALQGVPSLVAGGSPQTLQPVSSSHVAKAPSLTFASPASPVCASDSTLHGLESNSPLSPLSANYSSPLWAAEHLCRSPDIFSEQRQSKHRRFQNTLVVLHKSGLLEITLKTKELIRQNQATQVELDQLKEQTQLFIEATKSRAPQAWAKLQASLTPGSSNTGSDLEAFSDHPAI

SEQ ID NO: 17737 - protein, 103 aa, Homo sapiens
  Payload ID: 3565
  Gene Symbol: CIPC
  Gene Name: CLOCK-interacting pacemaker
  ENSP ID: ENSP00000450972
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQQ

SEQ ID NO: 17738 - protein, 141 aa, Homo sapiens
  Payload ID: 3565
  Gene Symbol: CIPC
  Gene Name: CLOCK-interacting pacemaker
  ENSP ID: ENSP00000451493
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVPSPVSPC

SEQ ID NO: 17739 - protein, 134 aa, Homo sapiens
  Payload ID: 3565
  Gene Symbol: CIPC
  Gene Name: CLOCK-interacting pacemaker
  ENSP ID: ENSP00000451522
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPV

SEQ ID NO: 17740 - protein, 61 aa, Homo sapiens
  Payload ID: 3565
  Gene Symbol: CIPC
  Gene Name: CLOCK-interacting pacemaker
  ENSP ID: ENSP00000451997
MERKNPSRESPRRLSAKVGKGTEMKKVARQLGMAAAESDKDSGFSGQQLIPAPVVDCPALL

SEQ ID NO: 17741 - protein, 151 aa, Homo sapiens
  Payload ID: 3565
  Gene Symbol: CIPC
  Gene Name: CLOCK-interacting pacemaker
  ENSP ID: ENSP00000452380
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVPSPVSPCHTGEKKSDSR

SEQ ID NO: 17742 - protein, 156 aa, Homo sapiens
  Payload ID: 3565
  Gene Symbol: CIPC
  Gene Name: CLOCK-interacting pacemaker
  ENSP ID: ENSP00000452589
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVPSPVSPCHTGEKKSDSRNYLPI

SEQ ID NO: 17743 - protein, 707 aa, Homo sapiens
  Payload ID: 3566
  Gene Symbol: CLPB
  Gene Name: ClpB homolog, mitochondrial AAA ATPase chaperonin
  Uniprot ID: Q9H078
  ENSP ID: ENSP00000294053
MLGSLVLRRKALAPRLLLRLLRSPTLRGHGGASGRNVTTGSLGEPQWLRVATGGRPGTSPALFSGRGAATGGRQGGRFDTKCLAAATWGRLPGPEETLPGQDSWNGVPSRAGLGMCALAAALVVHCYSKSPSNKDAALLEAARANNMQEVSRLLSEGADVNAKHRLGWTALMVAAINRNNSVVQVLLAAGADPNLGDDFSSVYKTAKEQGIHSLEDGGQDGASRHITNQWTSALEFRRWLGLPAGVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 17744 - protein, 648 aa, Homo sapiens
  Payload ID: 3566
  Gene Symbol: CLPB
  Gene Name: ClpB homolog, mitochondrial AAA ATPase chaperonin
  Uniprot ID: Q9H078
  ENSP ID: ENSP00000340385
MLGSLVLRRKALAPRLLLRLLRSPTLRGHGGASGRNVTTGSLGEPQWLRVATGGRPGTSPALFSGRGAATGGRQGGRFDTKCLAAATWGRLPGPEETLPGQDSWNGVPSRAGLGMCALAAALVVHCYSKSPSNKDAALLEAARANNMQEVSSVVQVLLAAGADPNLGDDFSSVYKTAKEQGIHSLEVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 17745 - protein, 662 aa, Homo sapiens
  Payload ID: 3566
  Gene Symbol: CLPB
  Gene Name: ClpB homolog, mitochondrial AAA ATPase chaperonin
  Uniprot ID: Q9H078
  ENSP ID: ENSP00000407296
MPRGCHLGTPSWSRRNTPRTGQLERGPQQGRTGHVRPGRSAGGSLLQQESVQQGCSPVGSCPCQQYARSQQPQETAKNDAQSRSWAGLNAGVSLKNTKISSSEWPLRLLSEGADVNAKHRLGWTALMVAAINRNNSVVQVLLAAGADPNLGDDFSSVYKTAKEQGIHSLEDGGQDGASRHITNQWTSALEFRRWLGLPAGVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 17746 - protein, 506 aa, Homo sapiens
  Payload ID: 3566
  Gene Symbol: CLPB
  Gene Name: ClpB homolog, mitochondrial AAA ATPase chaperonin
  Uniprot ID: Q9H078
  ENSP ID: ENSP00000439746
MVAAINRNNSVVQVLLAAGADPNLGDDFSSVYKTAKEQGIHSLEVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 17747 - protein, 501 aa, Homo sapiens
  Payload ID: 3566
  Gene Symbol: CLPB
  Gene Name: ClpB homolog, mitochondrial AAA ATPase chaperonin
  ENSP ID: ENSP00000440423
MLGSLVLRRKALAPRLLLRLLRSPTLRGHGGASGRNVTTGSLGEPQWLRVATGGRPGTSPALFSGRGAATGGRQGGRFDTKCLAAATWGRLPGPEETLPGQDSWNGVPSRAGLGMCALAAALVVHCYSKSPSNKDAALLEAARANNMQEVSRLLSEGADVNAKHRLGWTALMVAAINRNNSVVQVLLAAGADPNLGDDFSSVYKTAKEQGIHSLEVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGSLPEG

SEQ ID NO: 17748 - protein, 677 aa, Homo sapiens
  Payload ID: 3566
  Gene Symbol: CLPB
  Gene Name: ClpB homolog, mitochondrial AAA ATPase chaperonin
  Uniprot ID: Q9H078
  ENSP ID: ENSP00000441518
MLGSLVLRRKALAPRLLLRLLRSPTLRGHGGASGRNVTTGSLGEPQWLRVATGGRPGTSPALFSGRGAATGGRQGGRFDTKCLAAATWGRLPGPEETLPGQDSWNGVPSRAGLGMCALAAALVVHCYSKSPSNKDAALLEAARANNMQEVSRLLSEGADVNAKHRLGWTALMVAAINRNNSVVQVLLAAGADPNLGDDFSSVYKTAKEQGIHSLEVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 17749 - protein, 44 aa, Homo sapiens
  Payload ID: 3566
  Gene Symbol: CLPB
  Gene Name: ClpB homolog, mitochondrial AAA ATPase chaperonin
  ENSP ID: ENSP00000441804
  MOD_RES (1)..(1): Any amino acid
XGNPFFGRWGTGRCKPAHHKPVDKCPGVQEMARTPRWRPDHPRG

SEQ ID NO: 17750 - protein, 152 aa, Homo sapiens
  Payload ID: 3566
  Gene Symbol: CLPB
  Gene Name: ClpB homolog, mitochondrial AAA ATPase chaperonin
  ENSP ID: ENSP00000442651
MQEVSRLLSEGADVNAKHRLGWTALMVAAINRNNSVVQVLLAAGADPNLGDDFSSVYKTAKEQGIHSLEVLITREDDFNNRLNNRASFKGCTALHYAVLADDYRTVKELLDGGANPLQRNEMGHTPLDYAREGEVMKLLRTSEAKYQEKQRK

SEQ ID NO: 17751 - protein, 712 aa, Homo sapiens
  Payload ID: 3566
  Gene Symbol: CLPB
  Gene Name: ClpB homolog, mitochondrial AAA ATPase chaperonin
  ENSP ID: ENSP00000443822
CFRPECDYWESRGAAVAEGSHRGAPWNIAGLVLRTWGSHRGAPGRTLRYQMPRGCHLGTPSWSRRNTPRTGQLERGPQQGRTGHVRPGRSAGGSLLQQESVQQGCSPVGSCPCQQYARSQQPQETAKNDAQSRSWAGLNAGVSLKNTKISSSEWPLRLLSEGADVNAKHRLGWTALMVAAINRNNSVVQVLLAAGADPNLGDDFSSVYKTAKEQGIHSLEDGGQDGASRHITNQWTSALEFRRWLGLPAGVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 17752 - protein, 75 aa, Homo sapiens
  Payload ID: 3566
  Gene Symbol: CLPB
  Gene Name: ClpB homolog, mitochondrial AAA ATPase chaperonin
  ENSP ID: ENSP00000445180
GWYDEEHPLVFLFLGSSGIGKTELAKQTAKYMHKDAKKLVLACFHTGLHQAGHVRVPGATRGGQVYWVSTRLRWP

SEQ ID NO: 17753 - protein, 149 aa, Homo sapiens
  Payload ID: 3566
  Gene Symbol: CLPB
  Gene Name: ClpB homolog, mitochondrial AAA ATPase chaperonin
  ENSP ID: ENSP00000445327
MQEVSRLLSEGADVNAKHRLGWTALMVAAINRNNSVVQVLLAAGADPNLGDDFSSVYKTAKEQGIHSLEDGGQDGASRHITNQWTSALEFRRWLGLPAGVLITREDDFNNRLNNRASFKGCTALHYAVLADDYRTVKELLDGGANPLQR

SEQ ID NO: 17754 - protein, 538 aa, Homo sapiens
  Payload ID: 3567
  Gene Symbol: CLPTM1L
  Gene Name: CLPTM1-like
  Uniprot ID: Q96KA5
  ENSP ID: ENSP00000313854
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVIFLFLLDEQTSLLVLVPAGVGAAIELWKVKKALKMTIFWRGLMPEFQFGTYSESERKTEEYDTQAMKYLSYLLYPLCVGGAVYSLLNIKYKSWYSWLINSFVNGVYAFGFLFMLPQLFVNYKLKSVAHLPWKAFTYKAFNTFIDDVFAFIITMPTSHRLACFRDDVVFLVYLYQRWLYPVDKRRVNEFGESYEEKATRAPHTD

SEQ ID NO: 17755 - protein, 369 aa, Homo sapiens
  Payload ID: 3567
  Gene Symbol: CLPTM1L
  Gene Name: CLPTM1-like
  ENSP ID: ENSP00000423321
MVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKLWKVKKALKMTIFWRGLMPEFQFGTYSESERKTEEYDTQAMKYLSYLLYPLCVGGAVYSLLNIKYKSWYSWLINSFVNGVYAFGFLFMLPQLFVNYKLKSVAHLPWKAFTYKAFNTFIDDVFAFIITMPTSHRLACFRDDVVFLVYLYQRWLYPVDKRRVNEFGESYEEKATRAPHTD

SEQ ID NO: 17756 - protein, 538 aa, Homo sapiens; identical to SEQ ID NO: 17754
  Payload ID: 3567
  Gene Symbol: CLPTM1L
  Gene Name: CLPTM1-like
  Uniprot ID: Q96KA5
  ENSP ID: ENSP00000480372

SEQ ID NO: 17757 - protein, 369 aa, Homo sapiens; identical to SEQ ID NO: 17755
  Payload ID: 3567
  Gene Symbol: CLPTM1L
  Gene Name: CLPTM1-like
  ENSP ID: ENSP00000485923

SEQ ID NO: 17758 - protein, 369 aa, Homo sapiens; identical to SEQ ID NO: 17755
  Payload ID: 3567
  Gene Symbol: CLPTM1L
  Gene Name: CLPTM1-like
  ENSP ID: ENSP00000486059

SEQ ID NO: 17759 - protein, 1309 aa, Homo sapiens
  Payload ID: 3568
  Gene Symbol: CLUH
  Gene Name: clustered mitochondria (cluA/CLU1) homolog
  Uniprot ID: O75153
  ENSP ID: ENSP00000388872
MLLNGDCPESLKKEAAAAEPPRENGLDEAGPGDETTGQEVIVIQDTGFSVKILAPGIEPFSLQVSPQEMVQEIHQVLMDREDTCHRTCFSLHLDGNVLDHFSELRSVEGLQEGSVLRVVEEPYTVREARIHVRHVRDLLKSLDPSDAFNGVDCNSLSFLSVFTDGDLGDSGKRKKGLEMDPIDCTPPEYILPGSRERPLCPLQPQNRDWKPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTDPRSREVIRNACKAVGSISSTAFDIRFNPDIFSPGVRFPESCQDEVRDQKQLLKDAAAFLLSCQIPGLVKDCMEHAVLPVDGATLAEVMRQRGINMRYLGKVLELVLRSPARHQLDHVFKIGIGELITRSAKHIFKTYLQGVELSGLSAAISHFLNCFLSSYPNPVAHLPADELVSKKRNKRRKNRPPGAADNTAWAVMTPQELWKNICQEAKNYFDFDLECETVDQAVETYGLQKITLLREISLKTGIQVLLKEYSFDSRHKPAFTEEDVLNIFPVVKHVNPKASDAFHFFQSGQAKVQQGFLKEGCELINEALNLFNNVYGAMHVETCACLRLLARLHYIMGDYAEALSNQQKAVLMSERVMGTEHPNTIQEYMHLALYCFASSQLSTALSLLYRARYLMLLVFGEDHPEMALLDNNIGLVLHGVMEYDLSLRFLENALAVSTKYHGPKALKVALSHHLVARVYESKAEFRSALQHEKEGYTIYKTQLGEDHEKTKESSEYLKCLTQQAVALQRTMNEIYRNGSSANIPPLKFTAPSMASVLEQLNVINGILFIPLSQKDLENLKAEVARRHQLQEASRNRDRAEEPMATEPAPAGAPGDLGSQPPAAKDPSPSVQG

SEQ ID NO: 17760 - protein, 1309 aa, Homo sapiens; identical to SEQ ID NO: 17759
  Payload ID: 3568
  Gene Symbol: CLUH
  Gene Name: clustered mitochondria (cluA/CLU1) homolog
  Uniprot ID: O75153
  ENSP ID: ENSP00000458986

SEQ ID NO: 17761 - protein, 1236 aa, Homo sapiens
  Payload ID: 3568
  Gene Symbol: CLUH
  Gene Name: clustered mitochondria (cluA/CLU1) homolog
  ENSP ID: ENSP00000459540
MVIKTDELPAAAPADSAREHGSQAGGKGRPGAAELPSVMLLNGDCPESLKKEAAAAEPPRENGLDEAGPGDETTGQEVIVIQDTGFSVKILAPGIEPFSLQVSPQEMVQEIHQVLMDREDTCHRTCFSLHLDGNVLDHFSELRSVEGLQEGSVLRVVEEPYTVREARIHVRHVRDLLKSLDPSDAFNGVDCNSLSFLSVFTDGDLGDSGKRKKGLEMDPIDCTPPEYILPGSRERPLCPLQPQNRDWKPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTADPRSREVIRNACKAVGSISSTAFDIRFNPDIFSPGVRFPESCQDEVRDQKQLLKDAAAFLLSCQIPGLKIGIGELITRSAKHIFKTYLQGVELSGLSAAISHFLNCFLSSYPNPVAHLPADELVSKKRNKRRKNRPPGAADNTAWAVMTPQELWKNICQEAKNYFDFDLECETVDQAVETYGLQKITLLREISLKTGIQVLLKEYSFDSRHKPAFTEEDVLNIFPVVKHVNPKASDAFHFFQSGQAKVQQGFLKEGCELINEALNLFNNVYGAMHVETCACLRLLARLHYIMGDYAEALSNQQKAVLMSERVMGTEHPNTIQEYMHLALYCFASSQLSTALSLLYRARYLMLLVFGEDHPEMALLDNNIGLVLHGVMEYDLSLRFLENALAVSTKYHGPKALKVALSHHLVARVYESKAEFRSALQHEKEGYTIYKTQLGEDHEKTKESSEYLKCLTQQAVALQRTMNEIYRNGSSANIPPLKFTAPSMASVLEQLNVINGILFIPL

SEQ ID NO: 17762 - protein, 164 aa, Homo sapiens
  Payload ID: 3568
  Gene Symbol: CLUH
  Gene Name: clustered mitochondria (cluA/CLU1) homolog
  ENSP ID: ENSP00000460101
MLLNGDCPESLKKEAAAAEPPRENGLDEAGPGDETTGQEVIVIQDTGFSVKILAPGIEPFSLQVSPQEMVQEIHQVLMDREDTCHRTCFSLHLDGNVLDHFSELRSVEGLQEGSVLRVVEEPYTVREARIHVRHVRDLLKSLDPSDAFNGVDCNSLSFLSVFTD

SEQ ID NO: 17763 - protein, 91 aa, Homo sapiens
  Payload ID: 3568
  Gene Symbol: CLUH
  Gene Name: clustered mitochondria (cluA/CLU1) homolog
  ENSP ID: ENSP00000460173
MLLNGDCPESLKKEAAAAEPPRENGLDEAGPGDETTGQEVIVIQDTGFSVKILAPGIEPFSLQVSPQEMVQEIHQVLMDREDTCHRTCFSL

SEQ ID NO: 17764 - protein, 73 aa, Homo sapiens
  Payload ID: 3568
  Gene Symbol: CLUH
  Gene Name: clustered mitochondria (cluA/CLU1) homolog
  ENSP ID: ENSP00000460293
MLLNGDCPESLKKEAAAAEPPRENGLDEAGPGDETTGQEVIVIQDTGFSVKILAPGIEPFSLQVSPQEMVQEI

SEQ ID NO: 17765 - protein, 160 aa, Homo sapiens
  Payload ID: 3568
  Gene Symbol: CLUH
  Gene Name: clustered mitochondria (cluA/CLU1) homolog
  ENSP ID: ENSP00000461126
PPPGNRKMHGDLMYLFVITAEDRQVSITASTRGFYLNQSTAYHFNPKPASPRFLSHSLVELLNQISPTFKKNFAVLQKKRCTAGQPPRRSMPWIACVQRTPTPRGWAMRSTFLDRPETGMRSCRRRGSCLARTCLSGCSEKGPYSRCTATSPRQPPGAPW

SEQ ID NO: 17766 - protein, 1251 aa, Homo sapiens
  Payload ID: 3568
  Gene Symbol: CLUH
  Gene Name: clustered mitochondria (cluA/CLU1) homolog
  ENSP ID: ENSP00000464732
  MOD_RES (1)..(1): Any amino acid
XSLQVSPQEMVQEIHQVLMDREDTCHRTCFSLHLDGNVLDHFSELRSVEGLQEGSVLRVVEEPYTVREARIHVRHVRDLLKSLDPSDAFNGVDCNSLSFLSVFTDGDLGDSGKRKKGLEMDPIDCTPPEYILPGSRERPLCPLQPQNRDWKPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTADPRSREVIRNACKAVGSISSTAFDIRFNPDIFSPGVRFPESCQDEVRDQKQLLKDAAAFLLSCQIPGLVKDCMEHAVLPVDGATLAEVMRQRGINMRYLGKVLELVLRSPARHQLDHVFKIGIGELITRSAKHIFKTYLQGVELSGLSAAISHFLNCFLSSYPNPVAHLPADELVSKKRNKRRKNRPPGAADNTAWAVMTPQELWKNICQEAKNYFDFDLECETVDQAVETYGLQKITLLREISLKTGIQVLLKEYSFDSRHKPAFTEEDVLNIFPVVKHVNPKASDAFHFFQSGQAKVQQGFLKEGCELINEALNLFNNVYGAMHVETCACLRLLARLHYIMGDYAEALSNQQKAVLMSERVMGTEHPNTIQEYMHLALYCFASSQLSTALSLLYRARYLMLLVFGEDHPEMALLDNNIGLVLHGVMEYDLSLRFLENALAVSTKYHGPKALKVALSHHLVARVYESKAEFRSALQHEKEGYTIYKTQLGEDHEKTKESSEYLKCLTQQAVALQRTMNEIYRNGSSANIPPLKFTAPSMASVLEQLNVINGILFIPLSQKDLENLKAEVARRHQLQEASRNRDRAEEPMATEPAPAGAPGDLGSQPPAAKDPSPSVQG

SEQ ID NO: 17767 - protein, 449 aa, Homo sapiens
  Payload ID: 3569
  Gene Symbol: CLU
  Gene Name: clusterin
  Uniprot ID: P10909
  ENSP ID: ENSP00000315130
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 17768 - protein, 449 aa, Homo sapiens; identical to SEQ ID NO: 17767
  Payload ID: 3569
  Gene Symbol: CLU
  Gene Name: clusterin
  Uniprot ID: P10909
  ENSP ID: ENSP00000385419

SEQ ID NO: 17769 - protein, 82 aa, Homo sapiens
  Payload ID: 3569
  Gene Symbol: CLU
  Gene Name: clusterin
  ENSP ID: ENSP00000427868
MMKTLLLFVGLLLTWESGQVLGDQTVSDNELQEMSNQGSKYVNKEIQNAVNGVKQIKTLIEKTNEERKTLLSNLEEAKKKKE

SEQ ID NO: 17770 - protein, 140 aa, Homo sapiens
  Payload ID: 3569
  Gene Symbol: CLU
  Gene Name: clusterin
  ENSP ID: ENSP00000428033
  MOD_RES (1)..(1): Any amino acid
XADCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 17771 - protein, 82 aa, Homo sapiens; identical to SEQ ID NO: 17769
  Payload ID: 3569
  Gene Symbol: CLU
  Gene Name: clusterin
  ENSP ID: ENSP00000428526

SEQ ID NO: 17772 - protein, 129 aa, Homo sapiens
  Payload ID: 3569
  Gene Symbol: CLU
  Gene Name: clusterin
  ENSP ID: ENSP00000428779
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVC

SEQ ID NO: 17773 - protein, 32 aa, Homo sapiens
  Payload ID: 3569
  Gene Symbol: CLU
  Gene Name: clusterin
  ENSP ID: ENSP00000429087
MMKTLLLFVGLLLTWESGQVLGDQTVSDNELQ

SEQ ID NO: 17774 - protein, 204 aa, Homo sapiens
  Payload ID: 3569
  Gene Symbol: CLU
  Gene Name: clusterin
  ENSP ID: ENSP00000429336
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTY

SEQ ID NO: 17775 - protein, 449 aa, Homo sapiens; identical to SEQ ID NO: 17767
  Payload ID: 3569
  Gene Symbol: CLU
  Gene Name: clusterin
  Uniprot ID: P10909
  ENSP ID: ENSP00000429620

SEQ ID NO: 17776 - protein, 135 aa, Homo sapiens
  Payload ID: 3569
  Gene Symbol: CLU
  Gene Name: clusterin
  ENSP ID: ENSP00000429881
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGL

SEQ ID NO: 17777 - protein, 284 aa, Homo sapiens
  Payload ID: 3569
  Gene Symbol: CLU
  Gene Name: clusterin
  ENSP ID: ENSP00000430821
  MOD_RES (1)..(1): Any amino acid
XQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPV

SEQ ID NO: 17778 - protein, 139 aa, Homo sapiens
  Payload ID: 3569
  Gene Symbol: CLU
  Gene Name: clusterin
  ENSP ID: ENSP00000431026
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQ

SEQ ID NO: 17779 - protein, 271 aa, Homo sapiens
  Payload ID: 3569
  Gene Symbol: CLU
  Gene Name: clusterin
  ENSP ID: ENSP00000431070
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDSLMPFSPYEPLNFHAMFQPFLEMIHEAQQAMDIHFHSPAFQHPPTEFIREGDDDRTVCREIRHNSTGCLRMKDQCDKC

SEQ ID NO: 17780 - protein, 297 aa, Homo sapiens
  Payload ID: 3569
  Gene Symbol: CLU
  Gene Name: clusterin
  ENSP ID: ENSP00000453247
MEACKDSRIGGMMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCR

SEQ ID NO: 17781 - protein, 432 aa, Homo sapiens
  Payload ID: 3570
  Gene Symbol: CLUAP1
  Gene Name: clusterin associated protein 1
  ENSP ID: ENSP00000344392
MSFRDLRNFTEMMRALGYPRHISMENFRTPNFGLVSEVLLWLVKRYEPQTDIPPDVDTEQDRVFFIKAIAQFMATKAHIKLNTKKLYQADGYAVKELLKITSVLYNAMKTKGMEGSEIVEEDVNKFKFDLGSKIADLKAARQLASEITSKGASLYDLLGMEVELREMRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNMEAAPALLGKCKTSSSKKQEDSEESEIDMEDDDDEDDDLEDESISLSPTKPNRRVRKSEPLDESDNDF

SEQ ID NO: 17782 - protein, 28 aa, Homo sapiens
  Payload ID: 3570
  Gene Symbol: CLUAP1
  Gene Name: clusterin associated protein 1
  ENSP ID: ENSP00000458180
  MOD_RES (1)..(1): Any amino acid
XNRKEKIRTGKKSEATRDSAECQAMFYG

SEQ ID NO: 17783 - protein, 151 aa, Homo sapiens
  Payload ID: 3570
  Gene Symbol: CLUAP1
  Gene Name: clusterin associated protein 1
  ENSP ID: ENSP00000458513
MRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDID

SEQ ID NO: 17784 - protein, 201 aa, Homo sapiens
  Payload ID: 3570
  Gene Symbol: CLUAP1
  Gene Name: clusterin associated protein 1
  ENSP ID: ENSP00000458886
MSFRDLRNFTEMMRALGYPRHISMENFRTPNFGLVSEVLLWLVKRYEPQTDIPPDVDTEQDRVFFIKAIAQFMIADLKAARQLASEITSKGASLYDLLGMEVELREMRTEAIARPLEINETEKVMRIAIKEILTQVQKTKDLLNNVASDEANLEAKIEKRKLELERNRKRLETLQSVRPCFMDEYEKTEEELQKQYDTYLE

SEQ ID NO: 17785 - protein, 35 aa, Homo sapiens
  Payload ID: 3570
  Gene Symbol: CLUAP1
  Gene Name: clusterin associated protein 1
  ENSP ID: ENSP00000459399
MSFRDLRNMSPRLTSRLTWILNRTEFSSLRQLPSS

SEQ ID NO: 17786 - protein, 41 aa, Homo sapiens
  Payload ID: 3570
  Gene Symbol: CLUAP1
  Gene Name: clusterin associated protein 1
  ENSP ID: ENSP00000459602
MSFRDLRNMSPRLTSRLTWILNRTEFSSLRQLPSSWPPRHI

SEQ ID NO: 17787 - protein, 387 aa, Homo sapiens
  Payload ID: 3570
  Gene Symbol: CLUAP1
  Gene Name: clusterin associated protein 1
  ENSP ID: ENSP00000460706
MSFRDLRNFTEMMRALGYPRHISMENFRTPNFGLVSEVLLWLVKRYEPQTDIPPDVDTEQDRVFFIKAIAQFMATKAHIKLNTKKLYQADGYAVKELLKITSVLYNAMKTKGMEGSEIVEEDVNKFKFDLGSKIADLKAARQLASEITSKGASLYDLLGMEVELREMRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNVSPPLPSVVLCTLGLAVPIDGSG

SEQ ID NO: 17788 - protein, 413 aa, Homo sapiens
  Payload ID: 3570
  Gene Symbol: CLUAP1
  Gene Name: clusterin associated protein 1
  Uniprot ID: Q96AJ1
  ENSP ID: ENSP00000460850
MSFRDLRNFTEMMRALGYPRHISMENFRTPNFGLVSEVLLWLVKRYEPQTDIPPDVDTEQDRVFFIKAIAQFMATKAHIKLNTKKLYQADGYAVKELLKITSVLYNAMKTKGMEGSEIVEEDVNKFKFDLGSKIADLKAARQLASEITSKGASLYDLLGMEVELREMRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNEDSEESEIDMEDDDDEDDDLEDESISLSPTKPNRRVRKSEPLDESDNDF

SEQ ID NO: 17789 - protein, 247 aa, Homo sapiens
  Payload ID: 3570
  Gene Symbol: CLUAP1
  Gene Name: clusterin associated protein 1
  Uniprot ID: Q96AJ1
  ENSP ID: ENSP00000460889
MRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNEDSEESEIDMEDDDDEDDDLEDESISLSPTKPNRRVRKSEPLDESDNDF

SEQ ID NO: 17790 - protein, 50 aa, Homo sapiens
  Payload ID: 3570
  Gene Symbol: CLUAP1
  Gene Name: clusterin associated protein 1
  ENSP ID: ENSP00000460977
MSFRDLRNFTEMMRALGYPRHISMENFRTPNFGLVSEVLLWLVKRPPRHI

SEQ ID NO: 17791 - protein, 120 aa, Homo sapiens
  Payload ID: 3570
  Gene Symbol: CLUAP1
  Gene Name: clusterin associated protein 1
  ENSP ID: ENSP00000461063
MMRALGYPRHISMENFRTPNFGLVSEVLLWLVKRYEPQTDIPPDVDTEQDRVFFIKAIAQFMATKAHIKLNTKKLYQADGYAVKELLKITSVLYNAMKTKGMEGSEIVEEDVNKFKFDLG

SEQ ID NO: 17792 - protein, 466 aa, Homo sapiens
  Payload ID: 3571
  Gene Symbol: CLUL1
  Gene Name: clusterin-like 1 (retinal)
  Uniprot ID: Q15846
  ENSP ID: ENSP00000341128
MKPPLLVFIVCLLWLKDSHCAPTWKDKTAISENLKSFSEVGEIDADEEVKKALTGIKQMKIMMERKEKEHTNLMSTLKKCREEKQEALKLLNEVQEHLEEEERLCRESLADSWGECRSCLENNCMRIYTTCQPSWSSVKNKIERFFRKIYQFLFPFHEDNEKDLPISEKLIEEDAQLTQMEDVFSQLTVDVNSLFNRSFNVFRQMQQEFDQTFQSHFISDTDLTEPYFFPAFSKEPMTKADLEQCWDIPNFFQLFCNFSVSIYESVSETITKMLKAIEDLPKQDKAPDHGGLISKMLPGQDRGLCGELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW

SEQ ID NO: 17793 - protein, 466 aa, Homo sapiens; identical to SEQ ID NO: 17792
  Payload ID: 3571
  Gene Symbol: CLUL1
  Gene Name: clusterin-like 1 (retinal)
  Uniprot ID: Q15846
  ENSP ID: ENSP00000383449

SEQ ID NO: 17794 - protein, 518 aa, Homo sapiens
  Payload ID: 3571
  Gene Symbol: CLUL1
  Gene Name: clusterin-like 1 (retinal)
  ENSP ID: ENSP00000441726
MRTWDYRWSLALVAQTGVHCCNLSSLQPLPPRFKRFSCLSLSSGWDYSNSGNMKPPLLVFIVCLLWLKDSHCAPTWKDKTAISENLKSFSEVGEIDADEEVKKALTGIKQMKIMMERKEKEHTNLMSTLKKCREEKQEALKLLNEVQEHLEEEERLCRESLADSWGECRSCLENNCMRIYTTCQPSWSSVKNKIERFFRKIYQFLFPFHEDNEKDLPISEKLIEEDAQLTQMEDVFSQLTVDVNSLFNRSFNVFRQMQQEFDQTFQSHFISDTDLTEPYFFPAFSKEPMTKADLEQCWDIPNFFQLFCNFSVSIYESVSETITKMLKAIEDLPKQDKAPDHGGLISKMLPGQDRGLCGELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW

SEQ ID NO: 17795 - protein, 491 aa, Homo sapiens
  Payload ID: 3571
  Gene Symbol: CLUL1
  Gene Name: clusterin-like 1 (retinal)
  ENSP ID: ENSP00000463269
MNSMEAAVGTEVPLLDNLQHCNSGNMKPPLLVFIVCLLWLKDSHCAPTWKDKTAISENLKSFSEVGEIDADEEVKKALTGIKQMKIMMERKEKEHTNLMSTLKKCREEKQEALKLLNEVQEHLEEEERLCRESLADSWGECRSCLENNCMRIYTTCQPSWSSVKNKIERFFRKIYQFLFPFHEDNEKDLPISEKLIEEDAQLTQMEDVFSQLTVDVNSLFNRSFNVFRQMQQEFDQTFQSHFISDTDLTEPYFFPAFSKEPMTKADLEQCWDIPNFFQLFCNFSVSIYESVSETITKMLKAIEDLPKQDKAPDHGGLISKMLPGQDRGLCGELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW

SEQ ID NO: 17796 - protein, 466 aa, Homo sapiens; identical to SEQ ID NO: 17792
  Payload ID: 3571
  Gene Symbol: CLUL1
  Gene Name: clusterin-like 1 (retinal)
  Uniprot ID: Q15846
  ENSP ID: ENSP00000464642

SEQ ID NO: 17797 - protein, 82 aa, Homo sapiens
  Payload ID: 3571
  Gene Symbol: CLUL1
  Gene Name: clusterin-like 1 (retinal)
  ENSP ID: ENSP00000473520
MRTWDYSNSGNMKPPLLVFIVCLLWLKDSHCAPTWKDKTAISENLKSFSEVGEIDADEEVKKALTGIKQMKIMMERKEKEHT

SEQ ID NO: 17798 - protein, 34 aa, Homo sapiens
  Payload ID: 3571
  Gene Symbol: CLUL1
  Gene Name: clusterin-like 1 (retinal)
  ENSP ID: ENSP00000473543
  MOD_RES (1)..(1): Any amino acid
XQFGWVSELANQAPETEIIFNSIQVRRSNASYIQ

SEQ ID NO: 17799 - protein, 518 aa, Homo sapiens; identical to SEQ ID NO: 17794
  Payload ID: 3571
  Gene Symbol: CLUL1
  Gene Name: clusterin-like 1 (retinal)
  ENSP ID: ENSP00000481776

SEQ ID NO: 17800 - protein, 620 aa, Homo sapiens
  Payload ID: 3572
  Gene Symbol: CMIP
  Gene Name: c-Maf inducing protein
  Uniprot ID: Q8IY22
  ENSP ID: ENSP00000381120
MASVAQKKIYKYKKVLSNPSRWEVVLKEIRTLVDMALTSPLQDDSINQAPLEIVSKLLSENTNLTTQEHENIIVAIAPLLENNHPPPDLCEFFCKHCRERPRSMVVIEVFTPVVQRILKHNMDFGKCPRLRLFTQEYILALNELNAGMEVVKKFIQSMHGPTGHCPHPRVLPNLVAVCLAAIYSCYEEFINSRDNSPSLKEIRNGCQQPCDRKPTLPLRLLHPSPDLVSQEATLSEARLKSVVVASSEIHVEVERTSTAKPALTASAGNDSEPNLIDCLMVSPACSTMSIELGPQADRTLGCYVEILKLLSDYDDWRPSLASLLQPIPFPKEALAHEKFTKELKYVIQRFAEDPRQEVHSCLLSVRAGKDGWFQLYSPGGVACDDDGELFASMVHILMGSCYKTKKFLLSLAENKLGPCMLLALRGNQTMVEILCLMLEYNIIDNNDTQLQIISTLESTDVGKRMYEQLCDRQRELKELQRKGGPTRLTLPSKSTDADLARLLSSGSFGNLENLSLAFTNVTSACAEHLIKLPSLKQLNLWSTQFGDAGLRLLSEHLTMLQVLNLCETPVTDAGLLALSSMKSLCSLNMNSTKLSADTYEDLKAKLPNLKEVDVRYTEAW

SEQ ID NO: 17801 - protein, 679 aa, Homo sapiens
  Payload ID: 3572
  Gene Symbol: CMIP
  Gene Name: c-Maf inducing protein
  Uniprot ID: Q8IY22
  ENSP ID: ENSP00000440401
MGQAAEPTGYMENSVSYSAIEDVQLLSWENAPKYCLQLTIPGGTVLLQAANSYLRDQWFHSLQWKKKIYKYKKVLSNPSRWEVVLKEIRTLVDMALTSPLQDDSINQAPLEIVSKLLSENTNLTTQEHENIIVAIAPLLENNHPPPDLCEFFCKHCRERPRSMVVIEVFTPVVQRILKHNMDFGKCPRLRLFTQEYILALNELNAGMEVVKKFIQSMHGPTGHCPHPRVLPNLVAVCLAAIYSCYEEFINSRDNSPSLKEIRNGCQQPCDRKPTLPLRLLHPSPDLVSQEATLSEARLKSVVVASSEIHVEVERTSTAKPALTASAGNDSEPNLIDCLMVSPACSTMSIELGPQADRTLGCYVEILKLLSDYDDWRPSLASLLQPIPFPKEALAHEKFTKELKYVIQRFAEDPRQEVHSCLLSVRAGKDGWFQLYSPGGVACDDDGELFASMVHILMGSCYKTKKFLLSLAENKLGPCMLLALRGNQTMVEILCLMLEYNIIDNNDTQLQIISTLESTDVGKRMYEQLCDRQRELKELQRKGGPTRLTLPSKSTDADLARLLSSGSFGNLENLSLAFTNVTSACAEHLIKLPSLKQLNLWSTQFGDAGLRLLSEHLTMLQVLNLCETPVTDAGLLALSSMKSLCSLNMNSTKLSADTYEDLKAKLPNLKEVDVRYTEAW

SEQ ID NO: 17802 - protein, 773 aa, Homo sapiens
  Payload ID: 3572
  Gene Symbol: CMIP
  Gene Name: c-Maf inducing protein
  Uniprot ID: Q8IY22
  ENSP ID: ENSP00000446100
MDVTSSSGGGGDPRQIEETKPLLGGDVSAPEGTKMGAVPCRRALLLCNGMRYKLLQEGDIQVCVIRHPRTFLSKILTSKFLRRWEPHHLTLADNSLASATPTGYMENSVSYSAIEDVQLLSWENAPKYCLQLTIPGGTVLLQAANSYLRDQWFHSLQWKKKIYKYKKVLSNPSRWEVVLKEIRTLVDMALTSPLQDDSINQAPLEIVSKLLSENTNLTTQEHENIIVAIAPLLENNHPPPDLCEFFCKHCRERPRSMVVIEVFTPVVQRILKHNMDFGKCPRLRLFTQEYILALNELNAGMEVVKKFIQSMHGPTGHCPHPRVLPNLVAVCLAAIYSCYEEFINSRDNSPSLKEIRNGCQQPCDRKPTLPLRLLHPSPDLVSQEATLSEARLKSVVVASSEIHVEVERTSTAKPALTASAGNDSEPNLIDCLMVSPACSTMSIELGPQADRTLGCYVEILKLLSDYDDWRPSLASLLQPIPFPKEALAHEKFTKELKYVIQRFAEDPRQEVHSCLLSVRAGKDGWFQLYSPGGVACDDDGELFASMVHILMGSCYKTKKFLLSLAENKLGPCMLLALRGNQTMVEILCLMLEYNIIDNNDTQLQIISTLESTDVGKRMYEQLCDRQRELKELQRKGGPTRLTLPSKSTDADLARLLSSGSFGNLENLSLAFTNVTSACAEHLIKLPSLKQLNLWSTQFGDAGLRLLSEHLTMLQVLNLCETPVTDAGLLALSSMKSLCSLNMNSTKLSADTYEDLKAKLPNLKEVDVRYTEAW

SEQ ID NO: 17803 - protein, 586 aa, Homo sapiens
  Payload ID: 3572
  Gene Symbol: CMIP
  Gene Name: c-Maf inducing protein
  ENSP ID: ENSP00000478272
MALTSPLQDDSINQAPLEIVSKLLSENTNLTTQEHENIIVAIAPLLENNHPPPDLCEFFCKHCRERPRSMVVIEVFTPVVQRILKHNMDFGKCPRLRLFTQEYILALNELNAGMEVVKKFIQSMHGPTGHCPHPRVLPNLVAVCLAAIYSCYEEFINSRDNSPSLKEIRNGCQQPCDRKPTLPLRLLHPSPDLVSQEATLSEARLKSVVVASSEIHVEVERTSTAKPALTASAGNDSEPNLIDCLMVSPACSTMSIELGPQADRTLGCYVEILKLLSDYDDWRPSLASLLQPIPFPKEALAHEKFTKELKYVIQRFAEDPRQEVHSCLLSVRAGKDGWFQLYSPGGVACDDDGELFASMVHILMGSCYKTKKFLLSLAENKLGPCMLLALRGNQTMVEILCLMLEYNIIDNNDTQLQIISTLESTDVGKRMYEQLCDRQRELKELQRKGGPTRLTLPSKSTDADLARLLSSGSFGNLENLSLAFTNVTSACAEHLIKLPSLKQLNLWSTQFGDAGLRLLSEHLTMLQVLNLCETPVTDAGLLALSSMKSLCSLNMNSTKLSADTYEDLKAKLPNLKEVDVRYTEAW

SEQ ID NO: 17804 - protein, 125 aa, Homo sapiens
  Payload ID: 3572
  Gene Symbol: CMIP
  Gene Name: c-Maf inducing protein
  ENSP ID: ENSP00000478736
MALTSPLQDDSINQAPLEIVSKLLSENTNLTTQEHENIIVAIAPLLENNHPPPDLCEFFCKHCRERPRSMVVIEVFTPVVQRILKHNMVSHPAPTPRPQRPEHEAPRASLAFCVGTDLGNVVGPA

SEQ ID NO: 17805 - protein, 678 aa, Homo sapiens [sequence omitted]

SEQ ID NO: 17806 - protein, 279 aa, Homo sapiens
  Payload ID: 3573
  Gene Symbol: CMSS1
  Gene Name: cms1 ribosomal small subunit homolog (yeast)
  Uniprot ID: Q9BQ75
  ENSP ID: ENSP00000410396
MADDLGDEWWENQPTGAGSSPEASDGEGEGDTEVMQQETVPVPVPSEKTKQPKECFLIQPKERKENTTKTRKRRKKKITDVLAKSEPKPGLPEDLQKLMKDYYSSRRLVIELEELNLPDSCFLKANDLTHSLSSYLKEICPKWVKLRKNHSEKKSVLMLIICSSAVRALELIRSMTAFRGDGKVIKLFAKHIKVQAQVKLLEKRVVHLGVGTPGRIKELVKQGGLNLSPLKFLVFDWNWRDQKLRRMMDIPEIRKEVFELLEMGVLSLCKSESLKLGLF

SEQ ID NO: 17807 - protein, 225 aa, Homo sapiens
  Payload ID: 3573
  Gene Symbol: CMSS1
  Gene Name: cms1 ribosomal small subunit homolog (yeast)
  ENSP ID: ENSP00000417293
MQLVYKNPKECFLIQPKERKENTTKTRKRRKKKITDVLAKSEPKPGLPEDLQKLMKDYYSSRRLVIELEELNLPDSCFLKANDLTHSLSSYLKEICPKWVKLRKNHSEKKSVLMLIICSSAVRALELIRSMTAFRGDGKVIKLFAKHIKVQAQVKLLEKRVVHLGVGTPGRIKELVKQGGLNLSPLKFLVFDWNWRDQKLRRMMDIPEIRKEVFELLEMGVLSLC

SEQ ID NO: 17808 - protein, 38 aa, Homo sapiens
  Payload ID: 3573
  Gene Symbol: CMSS1
  Gene Name: cms1 ribosomal small subunit homolog (yeast)
  ENSP ID: ENSP00000418609
MADDLGDEWWENQPTGAGSSPGPLPVSSRVCASKYLKT

SEQ ID NO: 17809 - protein, 82 aa, Homo sapiens
  Payload ID: 3573
  Gene Symbol: CMSS1
  Gene Name: cms1 ribosomal small subunit homolog (yeast)
  ENSP ID: ENSP00000418762
  MOD_RES (1)..(1): Any amino acid
XEDLQKLMKDYYSSRRLVIELEELNLPDSCFLKANDLTHSLSSYLKEICPKWVKLRKNHSEKKSVLMLIICSSAVRALELIR

SEQ ID NO: 17810 - protein, 25 aa, Homo sapiens
  Payload ID: 3573
  Gene Symbol: CMSS1
  Gene Name: cms1 ribosomal small subunit homolog (yeast)
  ENSP ID: ENSP00000418855
MQQETVPVPVPSEKTKQPKECFLIQ

SEQ ID NO: 17811 - protein, 261 aa, Homo sapiens
  Payload ID: 3573
  Gene Symbol: CMSS1
  Gene Name: cms1 ribosomal small subunit homolog (yeast)
  Uniprot ID: Q9BQ75
  ENSP ID: ENSP00000419161
MHGEASDGEGEGDTEVMQQETVPVPVPSEKTKQPKECFLIQPKERKENTTKTRKRRKKKITDVLAKSEPKPGLPEDLQKLMKDYYSSRRLVIELEELNLPDSCFLKANDLTHSLSSYLKEICPKWVKLRKNHSEKKSVLMLIICSSAVRALELIRSMTAFRGDGKVIKLFAKHIKVQAQVKLLEKRVVHLGVGTPGRIKELVKQGGLNLSPLKFLVFDWNWRDQKLRRMMDIPEIRKEVFELLEMGVLSLCKSESLKLGLF

SEQ ID NO: 17812 - protein, 301 aa, Homo sapiens
  Payload ID: 3574
  Gene Symbol: CDRT1
  Gene Name: CMT1A duplicated region transcript 1
  ENSP ID: ENSP00000261644
  MOD_RES (1)..(1): Any amino acid
XSKAPENEHFLGAASNPEEPWRNSLRCISEMNRLFSGKADITKPGYDPCNLLVDLDDIRDLSSGFSKYRDFIRYLPIHLSKYILSMLGCMRGFPRHLPSWPSSGVSGSIFFFFPGMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLMEERNVFCGTYNVRILSDTWDQNRVIHYSGGDLIAVSSNRKIHLLDIIQVKAIPVEFRGHAGSVRALFLCEEENFLLSGSYDLSI

SEQ ID NO: 17813 - protein, 252 aa, Homo sapiens
  Payload ID: 3574
  Gene Symbol: CDRT1
  Gene Name: CMT1A duplicated region transcript 1
  Uniprot ID: O95170
  ENSP ID: ENSP00000346416
MDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVLDVSLLFLRVISACADGKIRIYNFFNGNCMKVIKANGRGDPVLSFFIQGNRISVCHISTFAKRINVGWNGIEPSATAQGGNASLTECAHVRLHIAGHLPASRLPVAAVQPMTGGMAPTTAPTHVLAMLILFSGV

SEQ ID NO: 17814 - protein, 714 aa, Homo sapiens
  Payload ID: 3574
  Gene Symbol: CDRT1
  Gene Name: CMT1A duplicated region transcript 1
  ENSP ID: ENSP00000379026
MENLESRLKNAPYFRCEKGTDSIPLCRKCETRVLAWKIFSTKEWFCRINDISQRRFLVGILKQLNSLYLLHYFQNILQTTQGKDFIYNRSRIDLSKKEGKVVKSSLNQMLDKTVEQKMKEILYWFANSTQWTKANYTLLLLQMCNPKLLLTAANVIRVLFLREENNISGLNQDITDVCFSPEKDHSSKSATSQVYWTAKTQHTSLPLSKAPENEHFLGAASNPEEPWRNSLRCISEMNRLFSGKADITKPGYDPCNLLVDLDDIRDLSSGFSKYRDFIRYLPIHLSKYILRMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLMEERNVFCGTYNVRILSDTWDQNRVIHYSGGDLIAVSSNRKIHLLDIIQVKAIPVEFRGHAGSVRALFLCEEENFLLSGSYDLSIRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVLDVSLLFLRVISACADGKIRIYNFFNGNCMKVIKANGRGDPVLSFFIQGNSDHLRKTYLPVEWKTDGRRVRKKAEKSAGMCCNNPRKTDDGLKLKH

SEQ ID NO: 17815 - protein, 752 aa, Homo sapiens
  Payload ID: 3574
  Gene Symbol: CDRT1
  Gene Name: CMT1A duplicated region transcript 1
  Uniprot ID: O95170
  ENSP ID: ENSP00000379242
MENLESRLKNAPYFRCEKGTDSIPLCRKCETRVLAWKIFSTKEWFCRINDISQRRFLVGILKQLNSLYLLHYFQNILQTTQGKDFIYNRSRIDLSKKEGKVVKSSLNQMLDKTVEQKMKEILYWFANSTQWTKANYTLLLLQMCNPKLLLTAANVIRVLFLREENNISGLNQDITDVCFSPEKDHSSKSATSQVYWTAKTQHTSLPLSKAPENEHFLGAASNPEEPWRNSLRCISEMNRLFSGKADITKPGYDPCNLLVDLDDIRDLSSGFSKYRDFIRYLPIHLSKYILRMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLMEERNVFCGTYNVRILSDTWDQNRVIHYSGGDLIAVSSNRKIHLLDIIQVKAIPVEFRGHAGSVRALFLCEEENFLLSGSYDLSIRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVLDVSLLFLRVISACADGKIRIYNFFNGNCMKVIKANGRGDPVLSFFIQGNRISVCHISTFAKRINVGWNGIEPSATAQGGNASLTECAHVRLHIAGHLPASRLPVAAVQPMTGGMAPTTAPTHVLAMLILFSGV

SEQ ID NO: 17816 - protein, 78 aa, Homo sapiens
  Payload ID: 3574
  Gene Symbol: CDRT1
  Gene Name: CMT1A duplicated region transcript 1
  ENSP ID: ENSP00000462959
MDLCKNRLVSGGRDCQVKVWDVDTGKCLKTFRHKDPILATRINDTYIVSSCERGLVKVWHIAMAQLVKNFSLPHQHIC

SEQ ID NO: 17817 - protein, 87 aa, Homo sapiens
  Payload ID: 3574
  Gene Symbol: CDRT1
  Gene Name: CMT1A duplicated region transcript 1
  ENSP ID: ENSP00000463684
MDLCKNRLVSGGRDCQVKVWDVDTGKCLKTFRHKDPILATRINDTYIVSSCERGLVKVWHIAMAQLVKEALMAWSWPGAWWGSTSAA

SEQ ID NO: 17818 - protein, 70 aa, Homo sapiens
  Payload ID: 3574
  Gene Symbol: CDRT1
  Gene Name: CMT1A duplicated region transcript 1
  ENSP ID: ENSP00000468137
  MOD_RES (1)..(1): Any amino acid
XNCMKVIKANGRGDPVLSFFIQGNSDHLRKTYLPVEWKTDGRRVRKKAEKSAGMCCNNPRKTDDGLKLKH

SEQ ID NO: 17819 - protein, 243 aa, Homo sapiens
  Payload ID: 3574
  Gene Symbol: CDRT1
  Gene Name: CMT1A duplicated region transcript 1
  ENSP ID: ENSP00000486674
MSPDQFLLTVSALQHARNSGEFAYPCRPQTEITDVWGPSISYPRKVLNFKGKSIQRAVDRLRLSNPPIDVKRTSIPLEIQKLQPNLKISLHSPRAQSTIPEPMIIRSRFSGSLKGGDQVTSSIERAVCSTGPLTSMQVIKPNRMLAPQVGTATLSLKKERPRIYTALDPFRVNAEFVLLTVKEEKEHQEAKMKEYQARESTGVVDPGKASKAAWIRKIKGLPIDNFTKQGKTAAPELGQNVFI

SEQ ID NO: 17820 - protein, 122 aa, Homo sapiens
  Payload ID: 3575
  Gene Symbol: CDRT15
  Gene Name: CMT1A duplicated region transcript 15
  ENSP ID: ENSP00000399575
MPKKAHPSPQTPVARCNKAHPAPGPCAEVRALPAPAAEPEPAWEEAPPERALELEGAPAKDQTNEELPEITEVPESIKRRLGRRVPAATPAPRGNLLLQAWMRVHSWASRLFAPNVLPGTGP

SEQ ID NO: 17821 - protein, 188 aa, Homo sapiens
  Payload ID: 3575
  Gene Symbol: CDRT15
  Gene Name: CMT1A duplicated region transcript 15
  Uniprot ID: Q96T59
  ENSP ID: ENSP00000402355
MFSCCFPTSRGCCFRNGGSESLFRRCRRRLIPHPRRLSPVVIRRIQVPQDSLGQALAGQATPEIPLGLQLHTVLVQEIQELIEAQTLAPGPCAEVRALPAPAAEPEPAWEEAPPERALELEGAPAKDQTNEELPEITEVPESIKRRLGRRVPAATPAPRGNLLLQAWMRVHSWASRLFAPNVLPGTGP

SEQ ID NO: 17822 - protein, 281 aa, Homo sapiens
  Payload ID: 3576
  Gene Symbol: CDRT15L2
  Gene Name: CMT1A duplicated region transcript 15-like 2
  Uniprot ID: A8MXV6
  ENSP ID: ENSP00000382000
MFSCCFPTSRGCCFRNGGSESLFRQCRRRLIPHPRRLWPFVRRRTQVPQDSPGQALAGQATPEIPSGLPLHIVLVQEEIREPMEAQTHAPGPYADIAALAAPAVEPKPAWEEPPPERALEVEGAPAKDQPSQELPEIMAPTVATGLNAGAENVAGERSGREGVTSTAPASRSHAAPSPGHGGKHGGGDQGIQTGLLYLAGERLLSFAGTTALLLQGLFIVLILVGYISVKVMLKSIKTRLGRRVPAAPPALRRNLLLQAWKCVCNWASRLFAPNVLPRTGS

SEQ ID NO: 17823 - protein, 24 aa, Homo sapiens
  Payload ID: 3577
  Gene Symbol: CDRT4
  Gene Name: CMT1A duplicated region transcript 4
  ENSP ID: ENSP00000452374
MDARRMKKEEGLTENTGLPRKLLE

SEQ ID NO: 17824 - protein, 152 aa, Homo sapiens
  Payload ID: 3577
  Gene Symbol: CDRT4
  Gene Name: CMT1A duplicated region transcript 4
  ENSP ID: ENSP00000482523
MDARRMKKEEGLTENTGLPRKLLEKHDPWPAYVTYTSQTVKRLIEKSKTRELECMRALEERPWASRQNKPSSVIQPKRRKSSKSSGKAVFRDTLSESTLSMWGAYSVLAMAPTMIPEPTHLHADSRDCPTENYNKIIFARKPMMRMLPTVRY

SEQ ID NO: 17825 - protein, 475 aa, Homo sapiens
  Payload ID: 3578
  Gene Symbol: CNDP2
  Gene Name: CNDP dipeptidase 2 (metallopeptidase M20 family)
  Uniprot ID: Q96KP4
  ENSP ID: ENSP00000325548
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 17826 - protein, 391 aa, Homo sapiens
  Payload ID: 3578
  Gene Symbol: CNDP2
  Gene Name: CNDP dipeptidase 2 (metallopeptidase M20 family)
  Uniprot ID: Q96KP4
  ENSP ID: ENSP00000325756
MAALTTLFKYIDENQDRYIKKLAKWVAIQSVSAWPEKRGEIRRMMEVAAADVKQLGGSVELVDIGKQKEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 17827 - protein, 88 aa, Homo sapiens
  Payload ID: 3578
  Gene Symbol: CNDP2
  Gene Name: CNDP dipeptidase 2 (metallopeptidase M20 family)
  ENSP ID: ENSP00000461941
MMEVAAADVKQLGGSVELVDIGKQKLPDGSEIPLPPILLGRLGSDPQKKTVCIYGHLDVQPAALEDGWDSEPFTLVERDGKLYGRGST

SEQ ID NO: 17828 - protein, 109 aa, Homo sapiens
  Payload ID: 3578
  Gene Symbol: CNDP2
  Gene Name: CNDP dipeptidase 2 (metallopeptidase M20 family)
  ENSP ID: ENSP00000462034
DELIFARKDTFFKDVDYVCISDNYWLGKKKPCITYGLRGICYFFIEVECSNKDLHSGVYGGSVHEAMTDLILLMGSLFPFPLVRSSMTLENRHKCIQLSTGGATRWAYE

SEQ ID NO: 17829 - protein, 475 aa, Homo sapiens; identical to SEQ ID NO: 17825
  Payload ID: 3578
  Gene Symbol: CNDP2
  Gene Name: CNDP dipeptidase 2 (metallopeptidase M20 family)
  Uniprot ID: Q96KP4
  ENSP ID: ENSP00000462311

SEQ ID NO: 17830 - protein, 55 aa, Homo sapiens
  Payload ID: 3578
  Gene Symbol: CNDP2
  Gene Name: CNDP dipeptidase 2 (metallopeptidase M20 family)
  ENSP ID: ENSP00000462626
MAALTTLFKYIDENQDRYIKKLAKWVAIQSVSAWPEKRGEIRRMMEVAAADVKQL

SEQ ID NO: 17831 - protein, 149 aa, Homo sapiens
  Payload ID: 3578
  Gene Symbol: CNDP2
  Gene Name: CNDP dipeptidase 2 (metallopeptidase M20 family)
  ENSP ID: ENSP00000462673
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQK

SEQ ID NO: 17832 - protein, 128 aa, Homo sapiens
  Payload ID: 3578
  Gene Symbol: CNDP2
  Gene Name: CNDP dipeptidase 2 (metallopeptidase M20 family)
  ENSP ID: ENSP00000463182
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGR

SEQ ID NO: 17833 - protein, 249 aa, Homo sapiens
  Payload ID: 3578
  Gene Symbol: CNDP2
  Gene Name: CNDP dipeptidase 2 (metallopeptidase M20 family)
  ENSP ID: ENSP00000463222
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLILLMGS

SEQ ID NO: 17834 - protein, 138 aa, Homo sapiens
  Payload ID: 3578
  Gene Symbol: CNDP2
  Gene Name: CNDP dipeptidase 2 (metallopeptidase M20 family)
  ENSP ID: ENSP00000463314
MAALTTLFKYIDENQDRYIKPVQLQQPQRVSLECGNVTGASSPSRTPFQNPSLLLVHKQKLAKWVAIQSVSAWPEKRGEIRRMMEVAAADVKQLGGSVELVDIGKQKLPDGSEIPLPPILLGRLGSDPQKKTVCIYGH

SEQ ID NO: 17835 - protein, 123 aa, Homo sapiens
  Payload ID: 3578
  Gene Symbol: CNDP2
  Gene Name: CNDP dipeptidase 2 (metallopeptidase M20 family)
  ENSP ID: ENSP00000463702
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDG

SEQ ID NO: 17836 - protein, 89 aa, Homo sapiens
  Payload ID: 3578
  Gene Symbol: CNDP2
  Gene Name: CNDP dipeptidase 2 (metallopeptidase M20 family)
  ENSP ID: ENSP00000463816
MAALTTLFKYIDENQDRYIKKLAKWVAIQSVSAWPEKRGEIRRMMEVAAADVKQLGGSVELVDIGKQKLPDGSEIPLPPILLGRLGSDP

SEQ ID NO: 17837 - protein, 122 aa, Homo sapiens
  Payload ID: 3578
  Gene Symbol: CNDP2
  Gene Name: CNDP dipeptidase 2 (metallopeptidase M20 family)
  ENSP ID: ENSP00000464014
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERD

SEQ ID NO: 17838 - protein, 138 aa, Homo sapiens
  Payload ID: 3578
  Gene Symbol: CNDP2
  Gene Name: CNDP dipeptidase 2 (metallopeptidase M20 family)
  ENSP ID: ENSP00000464122
MAALTTLFKYIDENQDRYIKKLAKWVAIQSVSAWPEKRGEIRRMMEVAAADVKQLGGSVELVDIGKQKEIPVNVRFCLEGMEESGSEGLDELIFARKDTFFKDVDYVCISDNYWLGKKKPCITYGLRGICYFFIEVEC

SEQ ID NO: 17839 - protein, 134 aa, Homo sapiens
  Payload ID: 3578
  Gene Symbol: CNDP2
  Gene Name: CNDP dipeptidase 2 (metallopeptidase M20 family)
  ENSP ID: ENSP00000464151
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDK

SEQ ID NO: 17840 - protein, 204 aa, Homo sapiens
  Payload ID: 3578
  Gene Symbol: CNDP2
  Gene Name: CNDP dipeptidase 2 (metallopeptidase M20 family)
  ENSP ID: ENSP00000464214
MPALRTRRGWWPGRPRGGPAPGVVAGTRGTEPAPRLLLVTGPCLVGLPSQLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVEC

SEQ ID NO: 17841 - protein, 89 aa, Homo sapiens
  Payload ID: 3578
  Gene Symbol: CNDP2
  Gene Name: CNDP dipeptidase 2 (metallopeptidase M20 family)
  ENSP ID: ENSP00000464319
MAALTTLFKYIDENQDRYIKVLSVKQYERVSLFPQYKQFLKSLTQSTRDGSVLFPISLFNCSSHRGNSQNGWLSRVCLRGRRREAKSGG

SEQ ID NO: 17842 - protein, 124 aa, Homo sapiens
  Payload ID: 3578
  Gene Symbol: CNDP2
  Gene Name: CNDP dipeptidase 2 (metallopeptidase M20 family)
  ENSP ID: ENSP00000479635
EIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQLLKGHNIGDSA

SEQ ID NO: 17843 - protein, 157 aa, Homo sapiens
  Payload ID: 3578
  Gene Symbol: CNDP2
  Gene Name: CNDP dipeptidase 2 (metallopeptidase M20 family)
  ENSP ID: ENSP00000482227
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQVCPPR

SEQ ID NO: 17844 - protein, 178 aa, Homo sapiens
  Payload ID: 3579
  Gene Symbol: CNKSR3
  Gene Name: CNKSR family member 3
  ENSP ID: ENSP00000393225
NIKPGEGLGMYIKSTYDGLHVITGTTENVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILP

SEQ ID NO: 17845 - protein, 475 aa, Homo sapiens
  Payload ID: 3579
  Gene Symbol: CNKSR3
  Gene Name: CNKSR family member 3
  ENSP ID: ENSP00000418975
MKNLVLKLRASSHNLQNYISSRRKSPAYDGNTSRKAPNEFLTSVVELIGAAKALLAWLDRAPFTGITDFSVTKNKIIQLCLDLTTTVQKDCFVAEMEDKVLTVVKVLNGICDKTIRSTTDPVMSQCACLEEVHLPNIKPGEGLGMYIKSTYDGLHVITGTTENSPADRSQKIHAGDEVIQVNQQTVVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPTKMREKTPSYGKPRPLSMPADGNWMGIVDPFARPRGHGRKGEDALCRYFSNERIPPIIEESSSPPYRFSRPTTERHLVRGADYIRGSRCYINSDLHSSATIPFQEEGTKKKSGSSATKSSSTEPSLLVSWFTRLKLLTH

SEQ ID NO: 17846 - protein, 555 aa, Homo sapiens
  Payload ID: 3579
  Gene Symbol: CNKSR3
  Gene Name: CNKSR family member 3
  Uniprot ID: Q6P9H4
  ENSP ID: ENSP00000475915
MEPVTKWSPKQVVDWTRGLDDCLQQYVHKFEREKINGEQLLQISHQDLEELGVTRIGHQELVLEAVDLLCALNYGLETDNMKNLVLKLRASSHNLQNYISSRRKSPAYDGNTSRKAPNEFLTSVVELIGAAKALLAWLDRAPFTGITDFSVTKNKIIQLCLDLTTTVQKDCFVAEMEDKVLTVVKVLNGICDKTIRSTTDPVMSQCACLEEVHLPNIKPGEGLGMYIKSTYDGLHVITGTTENSPADRSQKIHAGDEVIQVNQQTVVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPTKMREKTPSYGKPRPLSMPADGNWMGIVDPFARPRGHGRKGEDALCRYFSNERIPPIIEESSSPPYRFSRPTTERHLVRGADYIRGSRCYINSDLHSSATIPFQEEGTKKKSGSSATKSSSTEPSLLVSWFTRLKLLTH

SEQ ID NO: 17847 - protein, 899 aa, Homo sapiens
  Payload ID: 3579
  Gene Symbol: CNKSR3
  Gene Name: CNKSR family member 3
  ENSP ID: ENSP00000478800
MEPVTKWSPKQVVDWTRGLDDCLQQYVHKFEREKINGEQLLQISHQDLEELGVTRIGHQELVLEAVDLLCALNYGLETDNMKNLVLKLRASSHNLQNYISSRRKSPAYDGNTSRKAPNEFLTSVVELIGAAKALLAWLDRAPFTGITDFSVTKNKIIQLCLDLTTTVQKDCFVAEMEDKVLTVVKVLNGICDKTIRSTTDPVMSQCACLEEVHLPNIKPGEGLGMYIKSTYDGLHVITGTTENSPADRSQKIHAGDEVIQVNQQTVVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPTKMREKTPSYGKPRPLSMPADGNWMGIVDPFARPRGHGRKAFVSTKMTSYMAIDGSALVPLRQKPRRKTQGFLTMSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLGSAVIHQESTTKDEECYSESEQEDPEIAAETPPPPHASQTQSLTAQQASSSSPSLSGTSYSFSSLENTVKTPSSFPSSLSKERQSLPDTVNSLSAAEDEGQPITFAVQVHSPVPSEAGIHKALENSFVTSESGFLNSLSSDDTSSLSSNHDHLTVPDKPAGSKIMDKEETKVSEDDEMEKLYKSLEQASLSPLGDRRPSTKKELRKSFVKRCKNPSINEKLHKIRTLNSTLKCKEHDLAMINQLLDDPKLTARKYREWKVMNTLLIQDIYQQQRASPAPDDTDDTPQELKKSPSSPSVENSI

SEQ ID NO: 17848 - protein, 564 aa, Homo sapiens
  Payload ID: 3580
  Gene Symbol: COASY
  Gene Name: CoA synthase
  Uniprot ID: Q13057
  ENSP ID: ENSP00000377406
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 17849 - protein, 564 aa, Homo sapiens; identical to SEQ ID NO: 17848
  Payload ID: 3580
  Gene Symbol: COASY
  Gene Name: CoA synthase
  Uniprot ID: Q13057
  ENSP ID: ENSP00000393564

SEQ ID NO: 17850 - protein, 593 aa, Homo sapiens
  Payload ID: 3580
  Gene Symbol: COASY
  Gene Name: CoA synthase
  Uniprot ID: Q13057
  ENSP ID: ENSP00000464814
MRTPRLRAQPRGAVYQAPSPPPAPVGLGSMAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 17851 - protein, 219 aa, Homo sapiens
  Payload ID: 3580
  Gene Symbol: COASY
  Gene Name: CoA synthase
  ENSP ID: ENSP00000466838
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQ

SEQ ID NO: 17852 - protein, 90 aa, Homo sapiens
  Payload ID: 3580
  Gene Symbol: COASY
  Gene Name: CoA synthase
  ENSP ID: ENSP00000467174
MAVFRSGLLVLTTPLASLAPRLASILTSAARLVNHTLYVHLQPGMSLEGPAQPQSSPVQATFEVLDFITHLYAGADVHRHLDVRILLTNI

SEQ ID NO: 17853 - protein, 96 aa, Homo sapiens
  Payload ID: 3580
  Gene Symbol: COASY
  Gene Name: CoA synthase
  ENSP ID: ENSP00000467322
MRTPRLRAQPRGAVYQAPSPPPAPVVQNLAHPPEVVLTDFQTLDGSQYNPVKQQLVRYATSCYSCCPRLASVLLYSDYGIGEVPVEPLDVPLPSTI

SEQ ID NO: 17854 - protein, 98 aa, Homo sapiens
  Payload ID: 3580
  Gene Symbol: COASY
  Gene Name: CoA synthase
  ENSP ID: ENSP00000467519
MRTPRLRAQPRGAVYQAPSPPPAPVGLGSMAVFRSGLLVLTTPLASLAPRLASILTSAARLVNHTLYVHLQPGMSLEGPAQPQSSPVQATFEVLDFIT

SEQ ID NO: 17855 - protein, 115 aa, Homo sapiens
  Payload ID: 3580
  Gene Symbol: COASY
  Gene Name: CoA synthase
  ENSP ID: ENSP00000467687
MAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAF

SEQ ID NO: 17856 - protein, 147 aa, Homo sapiens
  Payload ID: 3580
  Gene Symbol: COASY
  Gene Name: CoA synthase
  ENSP ID: ENSP00000468583
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRL

SEQ ID NO: 17857 - protein, 128 aa, Homo sapiens
  Payload ID: 3580
  Gene Symbol: COASY
  Gene Name: CoA synthase
  ENSP ID: ENSP00000468755
MRTPRLRAQPRGAVYQAPSPPPAPVGLGSMAVFRSGLLVLTTPLASLAPRLASILTSAARLVNHTLYVHLQPGMSLEGPAQPQSSPVQATFEVLDFITHLYAGADVHRHLDVRILLTNIRTKSTFLPP

SEQ ID NO: 17858 - protein, 608 aa, Homo sapiens
  Payload ID: 3581
  Gene Symbol: CARM1
  Gene Name: coactivator-associated arginine methyltransferase 1
  Uniprot ID: Q86X55
  ENSP ID: ENSP00000325690
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLANTGIVNHTHSRMGSIMSTGIVQGSSGAQGSGGGSTSAHYAVNSQFTMGGPAISMASPMSIPTNTMHYGS

SEQ ID NO: 17859 - protein, 585 aa, Homo sapiens
  Payload ID: 3581
  Gene Symbol: CARM1
  Gene Name: coactivator-associated arginine methyltransferase 1
  Uniprot ID: Q86X55
  ENSP ID: ENSP00000340934
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLGSSGAQGSGGGSTSAHYAVNSQFTMGGPAISMASPMSIPTNTMHYGS

SEQ ID NO: 17860 - protein, 111 aa, Homo sapiens
  Payload ID: 3581
  Gene Symbol: CARM1
  Gene Name: coactivator-associated arginine methyltransferase 1
  ENSP ID: ENSP00000464852
AEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQMRKLRLREVK

SEQ ID NO: 17861 - protein, 120 aa, Homo sapiens
  Payload ID: 3581
  Gene Symbol: CARM1
  Gene Name: coactivator-associated arginine methyltransferase 1
  ENSP ID: ENSP00000465417
MAAAAAAVGPGAGGAGSAVPGGAGPCATVSVFPGARLLTIGDANGEIQRHAEQQALRLEVRAGPDSAGIALYSHFCSFYNILKTCRGHTLERSVFSERTEESSAVQYFQFYGYLSQQQNM

SEQ ID NO: 17862 - protein, 161 aa, Homo sapiens
  Payload ID: 3581
  Gene Symbol: CARM1
  Gene Name: coactivator-associated arginine methyltransferase 1
  ENSP ID: ENSP00000467420
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQMRKLRLREVK

SEQ ID NO: 17863 - protein, 343 aa, Homo sapiens
  Payload ID: 3581
  Gene Symbol: CARM1
  Gene Name: coactivator-associated arginine methyltransferase 1
  ENSP ID: ENSP00000467746
  MOD_RES (1)..(1): Any amino acid
XANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHSACLASPAATALCLPG

SEQ ID NO: 17864 - protein, 176 aa, Homo sapiens
  Payload ID: 3581
  Gene Symbol: CARM1
  Gene Name: coactivator-associated arginine methyltransferase 1
  ENSP ID: ENSP00000467761
LAFWFDVAFIGSIQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLANTGIVNHTHSRMGSIMSTGIVQGSSGAQGSGGGSTSAHYAVNSQFTMGGPAISMASPMSIPTNTMHYGS

SEQ ID NO: 17865 - protein, 92 aa, Homo sapiens
  Payload ID: 3581
  Gene Symbol: CARM1
  Gene Name: coactivator-associated arginine methyltransferase 1
  ENSP ID: ENSP00000468319
ALYSHEDVCVFKCSVSRETECSRVGKQSFIITLGCNSVLIQFATPNDFCSFYNILKTCRGHTLERSVFSERTEESSAVQYFQMRKLRLREVK

SEQ ID NO: 17866 - protein, 142 aa, Homo sapiens
  Payload ID: 3582
  Gene Symbol: COTL1
  Gene Name: coactosin-like F-actin binding protein 1
  Uniprot ID: Q14019
  ENSP ID: ENSP00000262428
MATKIDKEACRAAYNLVRDDGSAVIWVTFKYDGSTIVPGEQGAEYQHFIQQCTDDVRLFAFVRFTTGDAMSKRSKFALITWIGENVSGLQRAKTGTDKTLVKEVVQNFAKEFVISDRKELEEDFIKSELKKAGGANYDAQTE

SEQ ID NO: 17867 - protein, 73 aa, Homo sapiens
  Payload ID: 3582
  Gene Symbol: COTL1
  Gene Name: coactosin-like F-actin binding protein 1
  ENSP ID: ENSP00000457033
MSKRSKFALITWIGENVSGLQRAKTGTDKTLVKEVVQNFAKEFVISDRKELEEDFIKSELKKAGGANYDAQTE

SEQ ID NO: 17868 - protein, 48 aa, Homo sapiens
  Payload ID: 3582
  Gene Symbol: COTL1
  Gene Name: coactosin-like F-actin binding protein 1
  ENSP ID: ENSP00000480117
  MOD_RES (1)..(1): Any amino acid
XTIVPGEQGAEYQHFIQQCTGWSAVVQSQLTATSVSRVQEILLPQPPE

SEQ ID NO: 17869 - protein, 622 aa, Homo sapiens
  Payload ID: 3583
  Gene Symbol: F2
  Gene Name: coagulation factor II (thrombin)
  Uniprot ID: P00734
  ENSP ID: ENSP00000308541
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 17870 - protein, 324 aa, Homo sapiens
  Payload ID: 3583
  Gene Symbol: F2
  Gene Name: coagulation factor II (thrombin)
  ENSP ID: ENSP00000387413
MGWGLLAGQSTQSWPLMFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEA

SEQ ID NO: 17871 - protein, 583 aa, Homo sapiens
  Payload ID: 3583
  Gene Symbol: F2
  Gene Name: coagulation factor II (thrombin)
  ENSP ID: ENSP00000433907
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPSLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 17872 - protein, 425 aa, Homo sapiens
  Payload ID: 3584
  Gene Symbol: F2R
  Gene Name: coagulation factor II (thrombin) receptor
  Uniprot ID: P25116
  ENSP ID: ENSP00000321326
MGPRRLLLVAACFSLCGPLLSARTRARRPESKATNATLDPRSFLLRNPNDKYEPFWEDEEKNESGLTEYRLVSINKSSPLQKQLPAFISEDASGYLTSSWLTLFVPSVYTGVFVVSLPLNIMAIVVFILKMKVKKPAVVYMLHLATADVLFVSVLPFKISYYFSGSDWQFGSELCRFVTAAFYCNMYASILLMTVISIDRFLAVVYPMQSLSWRTLGRASFTCLAIWALAIAGVVPLLLKEQTIQVPGLNITTCHDVLNETLLEGYYAYYFSAFSAVFFFVPLIISTVCYVSIIRCLSSSAVANRSKKSRALFLSAAVFCIFIICFGPTNVLLIAHYSFLSHTSTTEAAYFAYLLCVCVSSISCCIDPLIYYYASSECQRYVYSILCCKESSDPSSYNSSGQLMASKMDTCSSNLNNSIYKKLLT

SEQ ID NO: 17873 - protein, 102 aa, Homo sapiens
  Payload ID: 3584
  Gene Symbol: F2R
  Gene Name: coagulation factor II (thrombin) receptor
  ENSP ID: ENSP00000426398
MGPRRLLLVAACFSLCGPLLSARTRARRPVTFRWGVPPPSRAQPMPLWTRSWRVQPACHGVLDMEEDGAEAPWGSLQSCVALVIVFLPGPPPKRKALTLLHQ

SEQ ID NO: 17874 - protein, 397 aa, Homo sapiens
  Payload ID: 3585
  Gene Symbol: F2RL1
  Gene Name: coagulation factor II (thrombin) receptor-like 1
  Uniprot ID: P55085
  ENSP ID: ENSP00000296677
MRSPSAAWLLGAAILLAASLSCSGTIQGTSRSSKGRSLIGKVDGTSHVTGKGVTVETVFSVDEFSASVLTGKLTTVFLPIVYTIVFVVGLPSNGMALWVFLFRTKKKHPAVIYMANLALADLLSVIWFPLKIAYHIHGNNWIYGEALCNVLIGFFYGNMYCSILFMTCLSVQRYWVIVNPMGHSRKKANIAIGISLAIWLLILLVTIPLYVVKQTIFIPALNITTCHDVLPEQLLVGDMFNYFLSLAIGVFLFPAFLTASAYVLMIRMLRSSAMDENSEKKRKRAIKLIVTVLAMYLICFTPSNLLLVVHYFLIKSQGQSHVYALYIVALCLSTLNSCIDPFVYYFVSHDFRDHAKNALLCRSVRTVKQMQVSLTSKKHSRKSSSYSSSSTTVKTSY

SEQ ID NO: 17875 - protein, 112 aa, Homo sapiens
  Payload ID: 3585
  Gene Symbol: F2RL1
  Gene Name: coagulation factor II (thrombin) receptor-like 1
  ENSP ID: ENSP00000425622
MALWVFLFRTKKKHPAVIYMANLALADLLSVIWFPLKIAYHIHGNNWIYGEALCNVLIGFFYGNMYCSILFMTCLSVQRYWVIVNPMGHSRKKANIAIGISLAIWLLILLVT

SEQ ID NO: 17876 - protein, 374 aa, Homo sapiens
  Payload ID: 3586
  Gene Symbol: F2RL2
  Gene Name: coagulation factor II (thrombin) receptor-like 2
  Uniprot ID: O00254
  ENSP ID: ENSP00000296641
MKALIFAAAGLLLLLPTFCQSGMENDTNNLAKPTLPIKTFRGAPPNSFEEFPFSALEGWTGATITVKIKCPEESASHLHVKNATMGYLTSSLSTKLIPAIYLLVFVVGVPANAVTLWMLFFRTRSICTTVFYTNLAIADFLFCVTLPFKIAYHLNGNNWVFGEVLCRATTVIFYGNMYCSILLLACISINRYLAIVHPFTYRGLPKHTYALVTCGLVWATVFLYMLPFFILKQEYYLVQPDITTCHDVHNTCESSSPFQLYYFISLAFFGFLIPFVLIIYCYAAIIRTLNAYDHRWLWYVKASLLILVIFTICFAPSNIILIIHHANYYYNNTDGLYFIYLIALCLGSLNSCLDPFLYFLMSKTRNHSTAYLTK

SEQ ID NO: 17877 - protein, 352 aa, Homo sapiens
  Payload ID: 3586
  Gene Symbol: F2RL2
  Gene Name: coagulation factor II (thrombin) receptor-like 2
  Uniprot ID: O00254
  ENSP ID: ENSP00000426703
MENDTNNLAKPTLPIKTFRGAPPNSFEEFPFSALEGWTGATITVKIKCPEESASHLHVKNATMGYLTSSLSTKLIPAIYLLVFVVGVPANAVTLWMLFFRTRSICTTVFYTNLAIADFLFCVTLPFKIAYHLNGNNWVFGEVLCRATTVIFYGNMYCSILLLACISINRYLAIVHPFTYRGLPKHTYALVTCGLVWATVFLYMLPFFILKQEYYLVQPDITTCHDVHNTCESSSPFQLYYFISLAFFGFLIPFVLIIYCYAAIIRTLNAYDHRWLWYVKASLLILVIFTICFAPSNIILIIHHANYYYNNTDGLYFIYLIALCLGSLNSCLDPFLYFLMSKTRNHSTAYLTK

SEQ ID NO: 17878 - protein, 385 aa, Homo sapiens
  Payload ID: 3587
  Gene Symbol: F2RL3
  Gene Name: coagulation factor II (thrombin) receptor-like 3
  Uniprot ID: Q96RI0
  ENSP ID: ENSP00000248076
MWGRLLLWPLVLGFSLSGGTQTPSVYDESGSTGGGDDSTPSILPAPRGYPGQVCANDSDTLELPDSSRALLLGWVPTRLVPALYGLVLVVGLPANGLALWVLATQAPRLPSTMLLMNLAAADLLLALALPPRIAYHLRGQRWPFGEAACRLATAALYGHMYGSVLLLAAVSLDRYLALVHPLRARALRGRRLALGLCMAAWLMAAALALPLTLQRQTFRLARSDRVLCHDALPLDAQASHWQPAFTCLALLGCFLPLLAMLLCYGATLHTLAASGRRYGHALRLTAVVLASAVAFFVPSNLLLLLHYSDPSPSAWGNLYGAYVPSLALSTLNSCVDPFIYYYVSAEFRDKVRAGLFQRSPGDTVASKASAEGGSRGMGTHSSLLQ

SEQ ID NO: 17879 - protein, 113 aa, Homo sapiens
  Payload ID: 3587
  Gene Symbol: F2RL3
  Gene Name: coagulation factor II (thrombin) receptor-like 3
  ENSP ID: ENSP00000471518
MWGRLLLWPLVLGFSLSGGTQTPSVYDESGSTGGGDARPQSCLPPAATQAKSVPMTVTPWSSRTAHGHCFWAGCPPGWCPPSMGWSWWWGCRPMGWRCGCWPRRHLGCPPPCC

SEQ ID NO: 17880 - protein, 295 aa, Homo sapiens
  Payload ID: 3588
  Gene Symbol: F3
  Gene Name: coagulation factor III (thromboplastin, tissue factor)
  Uniprot ID: P13726
  ENSP ID: ENSP00000334145
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREIFYIIGAVVFVVIILVIILAISLHKCRKAGVGQSWKENSPLNVS

SEQ ID NO: 17881 - protein, 238 aa, Homo sapiens
  Payload ID: 3588
  Gene Symbol: F3
  Gene Name: coagulation factor III (thromboplastin, tissue factor)
  Uniprot ID: P13726
  ENSP ID: ENSP00000359226
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKYSTSLELWYLWSSSLSSSWLYLYTSVERQEWGRAGRRTPH

SEQ ID NO: 17882 - protein, 461 aa, Homo sapiens
  Payload ID: 3589
  Gene Symbol: F9
  Gene Name: coagulation factor IX
  Uniprot ID: P00740
  ENSP ID: ENSP00000218099
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 17883 - protein, 423 aa, Homo sapiens
  Payload ID: 3589
  Gene Symbol: F9
  Gene Name: coagulation factor IX
  Uniprot ID: P00740
  ENSP ID: ENSP00000377650
MQRVNMIMAESPGLITICLLGYLLSAECTVFLDHENANKILNRPKRYNSGKLEEFVQGNLERECMEEKCSFEEAREVFENTERTTEFWKQYVDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 17884 - protein, 2229 aa, Homo sapiens
  Payload ID: 3590
  Gene Symbol: F5
  Gene Name: coagulation factor V (proaccelerin, labile factor)
  ENSP ID: ENSP00000356770
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSNFTLSAINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPMDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 17885 - protein, 2224 aa, Homo sapiens
  Payload ID: 3590
  Gene Symbol: F5
  Gene Name: coagulation factor V (proaccelerin, labile factor)
  Uniprot ID: P12259
  ENSP ID: ENSP00000356771
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPMDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 17886 - protein, 444 aa, Homo sapiens
  Payload ID: 3591
  Gene Symbol: F7
  Gene Name: coagulation factor VII (serum prothrombin conversion accelerator)
  Uniprot ID: P08709
  ENSP ID: ENSP00000329546
MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 17887 - protein, 466 aa, Homo sapiens
  Payload ID: 3591
  Gene Symbol: F7
  Gene Name: coagulation factor VII (serum prothrombin conversion accelerator)
  Uniprot ID: P08709
  ENSP ID: ENSP00000364731
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 17888 - protein, 74 aa, Homo sapiens
  Payload ID: 3591
  Gene Symbol: F7
  Gene Name: coagulation factor VII (serum prothrombin conversion accelerator)
  ENSP ID: ENSP00000387669
MVSQALRLLCLLLGLQGCLAAGGSPRRPAPAPARQRVPGGAAAGLPGEGVQGGAVLLRGGPGDLQGRGEDVVSG

SEQ ID NO: 17889 - protein, 382 aa, Homo sapiens
  Payload ID: 3591
  Gene Symbol: F7
  Gene Name: coagulation factor VII (serum prothrombin conversion accelerator)
  ENSP ID: ENSP00000442051
MVSQALRLLCLLLGLQGCLAADGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 17890 - protein, 216 aa, Homo sapiens
  Payload ID: 3592
  Gene Symbol: F8
  Gene Name: coagulation factor VIII, procoagulant component
  Uniprot ID: P00451
  ENSP ID: ENSP00000327895
MRIQDPGKVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 17891 - protein, 2351 aa, Homo sapiens
  Payload ID: 3592
  Gene Symbol: F8
  Gene Name: coagulation factor VIII, procoagulant component
  Uniprot ID: P00451
  ENSP ID: ENSP00000353393
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 17892 - protein, 164 aa, Homo sapiens
  Payload ID: 3592
  Gene Symbol: F8
  Gene Name: coagulation factor VIII, procoagulant component
  ENSP ID: ENSP00000389153
MHRDARAQKASRGATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDP

SEQ ID NO: 17893 - protein, 222 aa, Homo sapiens
  Payload ID: 3592
  Gene Symbol: F8
  Gene Name: coagulation factor VIII, procoagulant component
  ENSP ID: ENSP00000409446
MHRDARAQKASRGFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYV

SEQ ID NO: 17894 - protein, 371 aa, Homo sapiens
  Payload ID: 3593
  Gene Symbol: F8A1
  Gene Name: coagulation factor VIII-associated 1
  Uniprot ID: P23610
  ENSP ID: ENSP00000479624
MAAAAAGLGGGGAGPGPEAGDFLARYRLVSNKLKKRFLRKPNVAEAGEQFGQLGRELRAQECLPYAAWCQLAVARCQQALFHGPGEALALTEAARLFLRQERDARQRLVCPAAYGEPLQAAASALGAAVRLHLELGQPAAAAALCLELAAALRDLGQPAAAAGHFQRAAQLQLPQLPLAALQALGEAASCQLLARDYTGALAVFTRMQRLAREHGSHPVQSLPPPPPPAPQPGPGATPALPAALLPPNSGSAAPSPAALGAFSDVLVRCEVSRVLLLLLLQPPPAKLLPEHAQTLEKYSWEAFDSHGQESSGQLPEELFLLLQSLVMATHEKDTEAIKSLQVEMWPLLTAEQNHLLHLVLQETISPSGQGV

SEQ ID NO: 17895 - protein, 371 aa, Homo sapiens; identical to SEQ ID NO: 17894
  Payload ID: 3594
  Gene Symbol: F8A2
  Gene Name: coagulation factor VIII-associated 2
  Uniprot ID: P23610
  ENSP ID: ENSP00000358518

SEQ ID NO: 17896 - protein, 371 aa, Homo sapiens; identical to SEQ ID NO: 17894
  Payload ID: 3595
  Gene Symbol: F8A3
  Gene Name: coagulation factor VIII-associated 3
  Uniprot ID: P23610
  ENSP ID: ENSP00000477530

SEQ ID NO: 17897 - protein, 332 aa, Homo sapiens
  Payload ID: 3596
  Gene Symbol: F10
  Gene Name: coagulation factor X
  ENSP ID: ENSP00000364701
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKGTGTRSRRRAVRRCTRWRWSSSTTGSQRRPMTSTSPCSGSRPPSPSA

SEQ ID NO: 17898 - protein, 488 aa, Homo sapiens
  Payload ID: 3596
  Gene Symbol: F10
  Gene Name: coagulation factor X
  Uniprot ID: P00742
  ENSP ID: ENSP00000364709
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 17899 - protein, 130 aa, Homo sapiens
  Payload ID: 3596
  Gene Symbol: F10
  Gene Name: coagulation factor X
  ENSP ID: ENSP00000386320
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELCMLIFAL

SEQ ID NO: 17900 - protein, 334 aa, Homo sapiens
  Payload ID: 3596
  Gene Symbol: F10
  Gene Name: coagulation factor X
  ENSP ID: ENSP00000387092
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRGTGTRSRRRAVRRCTRWRWSSSTTGSQRRPMTSTSPCSGSRPPSPSA

SEQ ID NO: 17901 - protein, 159 aa, Homo sapiens
  Payload ID: 3597
  Gene Symbol: F11
  Gene Name: coagulation factor XI
  ENSP ID: ENSP00000264691
  MOD_RES (1)..(1): Any amino acid
XVESPKILRVYSGILNQSEIKEDTSFFGVQEIIIHDQYKMAESGYDIALLKLETTVNYTDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 17902 - protein, 571 aa, Homo sapiens
  Payload ID: 3597
  Gene Symbol: F11
  Gene Name: coagulation factor XI
  Uniprot ID: P03951
  ENSP ID: ENSP00000264692
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 17903 - protein, 625 aa, Homo sapiens
  Payload ID: 3597
  Gene Symbol: F11
  Gene Name: coagulation factor XI
  Uniprot ID: P03951
  ENSP ID: ENSP00000384957
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHRNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 17904 - protein, 210 aa, Homo sapiens
  Payload ID: 3597
  Gene Symbol: F11
  Gene Name: coagulation factor XI
  ENSP ID: ENSP00000397401
  MOD_RES (1)..(1): Any amino acid
XSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNELRGAPMKISGWLKTS

SEQ ID NO: 17905 - protein, 162 aa, Homo sapiens
  Payload ID: 3597
  Gene Symbol: F11
  Gene Name: coagulation factor XI
  ENSP ID: ENSP00000424479
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHR

SEQ ID NO: 17906 - protein, 615 aa, Homo sapiens
  Payload ID: 3598
  Gene Symbol: F12
  Gene Name: coagulation factor XII (Hageman factor)
  Uniprot ID: P00748
  ENSP ID: ENSP00000253496
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGAFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 17907 - protein, 732 aa, Homo sapiens
  Payload ID: 3599
  Gene Symbol: F13A1
  Gene Name: coagulation factor XIII, A1 polypeptide
  Uniprot ID: P00488
  ENSP ID: ENSP00000264870
MSETSRTAFGGRRAVPPNNSNAAEDDLPTVELQGVVPRGVNLQEFLNVTSVHLFKERWDTNKVDHHTDKYENNKLIVRRGQSFYVQIDFSRPYDPRRDLFRVEYVIGRYPQENKGTYIPVPIVSELQSGKWGAKIVMREDRSVRLSIQSSPKCIVGKFRMYVAVWTPYGVLRTSRNPETDTYILFNPWCEDDAVYLDNEKEREEYVLNDIGVIFYGEVNDIKTRSWSYGQFEDGILDTCLYVMDRAQMDLSGRGNPIKVSRVGSAMVNAKDDEGVLVGSWDNIYAYGVPPSAWTGSVDILLEYRSSENPVRYGQCWVFAGVFNTFLRCLGIPARIVTNYFSAHDNDANLQMDIFLEEDGNVNSKLTKDSVWNYHCWNEAWMTRPDLPVGFGGWQAVDSTPQENSDGMYRCGPASVQAIKHGHVCFQFDAPFVFAEVNSDLIYITAKKDGTHVVENVDATHIGKLIVTKQIGGDGMMDITDTYKFQEGQEEERLALETALMYGAKKPLNTEGVMKSRSNVDMDFEVENAVLGKDFKLSITFRNNSHNRYTITAYLSANITFYTGVPKAEFKKETFDVTLEPLSFKKEAVLIQAGEYMGQLLEQASLHFFVTARINETRDVLAKQKSTVLTIPEIIIKVRGTQVVGSDMTVTVEFTNPLKETLRNVWVHLDGPGVTRPMKKMFREIRPNSTVQWEEVCRPWVSGHRKLIASMSSDSLRHVYGELDVQIQRRPSM

SEQ ID NO: 17908 - protein, 102 aa, Homo sapiens
  Payload ID: 3599
  Gene Symbol: F13A1
  Gene Name: coagulation factor XIII, A1 polypeptide
  ENSP ID: ENSP00000394693
  MOD_RES (1)..(1): Any amino acid
XAYGVPPSAWTGSVDILLEYRSSENPVRYGQCWVFAGVFNTFLRCLGIPARIVTNYFSAHDNDANLQMDIFLEEDGNVNSKLTKDSVWYPSIPAAGMSPKSA

SEQ ID NO: 17909 - protein, 147 aa, Homo sapiens
  Payload ID: 3599
  Gene Symbol: F13A1
  Gene Name: coagulation factor XIII, A1 polypeptide
  ENSP ID: ENSP00000411114
  MOD_RES (1)..(1): Any amino acid
XEAHRASPREGTSGGERLQDLVKSKMSETSRTAFGGRRAVPPNNSNAAEDDLPTVELQGVVPRGVNLQEFLNVTSVHLFKERWDTNKVDHHTDKYENNKLIVRRGQSFYVQIDFSRPYDPRRDLFRVEYVIGECHVQAPVLTPWVAL

SEQ ID NO: 17910 - protein, 138 aa, Homo sapiens
  Payload ID: 3599
  Gene Symbol: F13A1
  Gene Name: coagulation factor XIII, A1 polypeptide
  ENSP ID: ENSP00000413334
MSETSRTAFGGRRAVPPNNSNAAEDDLPTVELQGVVPRGVNLQEFLNVTSVHLFKERWDTNKVDHHTDKYENNKLIVRRGQSFYVQIDFSRPYDPRRDLFRVEYVIGRYPQENKGTYIPVPIVSELQSGKWGAKIVMR

SEQ ID NO: 17911 - protein, 185 aa, Homo sapiens
  Payload ID: 3599
  Gene Symbol: F13A1
  Gene Name: coagulation factor XIII, A1 polypeptide
  ENSP ID: ENSP00000416295
MGNWESEGQVGEKGAPAGITGQMNPFEEVPEAHRASPREGTSGGERLQDLVKSKMSETSRTAFGGRRAVPPNNSNAAEDDLPTVELQGVVPRGVNLQEFLNVTSVHLFKERWDTNKVDHHTDKYENNKLIVRRGQSFYVQIDFSRPYDPRRDLFRVEYVIGRYPQENKGTYIPVPIVSELQSGKW

SEQ ID NO: 17912 - protein, 661 aa, Homo sapiens
  Payload ID: 3600
  Gene Symbol: F13B
  Gene Name: coagulation factor XIII, B polypeptide
  Uniprot ID: P05160
  ENSP ID: ENSP00000356382
MRLKNLTFIIILIISGELYAEEKPCGFPHVENGRIAQYYYTFKSFYFPMSIDKKLSFFCLAGYTTESGRQEEQTTCTTEGWSPEPRCFKKCTKPDLSNGYISDVKLLYKIQENMRYGCASGYKTTGGKDEEVVQCLSDGWSSQPTCRKEHETCLAPELYNGNYSTTQKTFKVKDKVQYECATGYYTAGGKKTEEVECLTYGWSLTPKCTKLKCSSLRLIENGYFHPVKQTYEEGDVVQFFCHENYYLSGSDLIQCYNFGWYPESPVCEGRRNRCPPPPLPINSKIQTHSTTYRHGEIVHIECELNFEIHGSAEIRCEDGKWTEPPKCIEGQEKVACEEPPFIENGAANLHSKIYYNGDKVTYACKSGYLLHGSNEITCNRGKWTLPPECVENNENCKHPPVVMNGAVADGILASYATGSSVEYRCNEYYLLRGSKISRCEQGKWSSPPVCLEPCTVNVDYMNRNNIEMKWKYEGKVLHGDLIDFVCKQGYDLSPLTPLSELSVQCNRGEVKYPLCTRKESKGMCTSPPLIKHGVIISSTVDTYENGSSVEYRCFDHHFLEGSREAYCLDGMWTTPPLCLEPCTLSFTEMEKNNLLLKWDFDNRPHILHGEYIEFICRGDTYPAELYITGSILRMQCDRGQLKYPRCIPRQSTLSYQEPLRT

SEQ ID NO: 17913 - protein, 1224 aa, Homo sapiens
  Payload ID: 3601
  Gene Symbol: COPA
  Gene Name: coatomer protein complex, subunit alpha
  Uniprot ID: P53621
  ENSP ID: ENSP00000241704
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 17914 - protein, 1233 aa, Homo sapiens
  Payload ID: 3601
  Gene Symbol: COPA
  Gene Name: coatomer protein complex, subunit alpha
  Uniprot ID: P53621
  ENSP ID: ENSP00000357048
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHEHSCPLPLTAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 17915 - protein, 953 aa, Homo sapiens
  Payload ID: 3602
  Gene Symbol: COPB1
  Gene Name: coatomer protein complex, subunit beta 1
  Uniprot ID: P53618
  ENSP ID: ENSP00000249923
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLIELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDNNEAAAADVLEFVREAIQRFDNLRMLIVEKMLEVFHAIKSVKIYRGALWILGEYCSTKEDIQSVMTEIRRSLGEIPIVESEIKKEAGELKPEEEITVGPVQKLVTEMGTYATQSALSSSRPTKKEEDRPPLRGFLLDGDFFVAASLATTLTKIALRYVALVQEKKKQNSFVAEAMLLMATILHLGKSSLPKKPITDDDVDRISLCLKVLSECSPLMNDIFNKECRQSLSHMLSAKLEEEKLSQKKESEKRNVTVQPDDPISFMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKVTVNTNMVDLNDYLQHILKSTNMKCLTPEKALSGYCGFMAANLYARSIFGEDALANVSIEKPIHQGPDAAVTGHIRIRAKSQGMALSLGDKINLSQKKTSI

SEQ ID NO: 17916 - protein, 953 aa, Homo sapiens; identical to SEQ ID NO: 17915
  Payload ID: 3602
  Gene Symbol: COPB1
  Gene Name: coatomer protein complex, subunit beta 1
  Uniprot ID: P53618
  ENSP ID: ENSP00000397873

SEQ ID NO: 17917 - protein, 137 aa, Homo sapiens
  Payload ID: 3602
  Gene Symbol: COPB1
  Gene Name: coatomer protein complex, subunit beta 1
  ENSP ID: ENSP00000431530
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLM

SEQ ID NO: 17918 - protein, 485 aa, Homo sapiens
  Payload ID: 3602
  Gene Symbol: COPB1
  Gene Name: coatomer protein complex, subunit beta 1
  ENSP ID: ENSP00000436383
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLIELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDNNEAAAADVLEFVREAIQRFDNLRMLIVEKMLEVFHAIKSVKIYRGALWILGEYCSTKEDIQSVMTEIRRSLGE

SEQ ID NO: 17919 - protein, 132 aa, Homo sapiens
  Payload ID: 3602
  Gene Symbol: COPB1
  Gene Name: coatomer protein complex, subunit beta 1
  ENSP ID: ENSP00000436401
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAEL

SEQ ID NO: 17920 - protein, 906 aa, Homo sapiens
  Payload ID: 3603
  Gene Symbol: COPB2
  Gene Name: coatomer protein complex, subunit beta 2 (beta prime)
  Uniprot ID: P35606
  ENSP ID: ENSP00000329419
MPLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 17921 - protein, 877 aa, Homo sapiens
  Payload ID: 3603
  Gene Symbol: COPB2
  Gene Name: coatomer protein complex, subunit beta 2 (beta prime)
  Uniprot ID: P35606
  ENSP ID: ENSP00000422295
MLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 17922 - protein, 77 aa, Homo sapiens
  Payload ID: 3603
  Gene Symbol: COPB2
  Gene Name: coatomer protein complex, subunit beta 2 (beta prime)
  ENSP ID: ENSP00000422469
MLASLYNGSVCVWNHETQTLVKTFEVCDLPVRAAKFVARKNWVVTGADDMQIRVFNYNTLERVHMFEAHSDYIRCIA

SEQ ID NO: 17923 - protein, 111 aa, Homo sapiens
  Payload ID: 3603
  Gene Symbol: COPB2
  Gene Name: coatomer protein complex, subunit beta 2 (beta prime)
  ENSP ID: ENSP00000422547
MLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEG

SEQ ID NO: 17924 - protein, 177 aa, Homo sapiens
  Payload ID: 3603
  Gene Symbol: COPB2
  Gene Name: coatomer protein complex, subunit beta 2 (beta prime)
  ENSP ID: ENSP00000422917
YTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVDLDNLELEDIDTTDINLDEDILDD

SEQ ID NO: 17925 - protein, 152 aa, Homo sapiens
  Payload ID: 3603
  Gene Symbol: COPB2
  Gene Name: coatomer protein complex, subunit beta 2 (beta prime)
  ENSP ID: ENSP00000423271
MPLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFILTSSGHTHYVMQIVINPKDNNQFASASLDRTIKVWQLG

SEQ ID NO: 17926 - protein, 89 aa, Homo sapiens
  Payload ID: 3603
  Gene Symbol: COPB2
  Gene Name: coatomer protein complex, subunit beta 2 (beta prime)
  ENSP ID: ENSP00000424144
MLASLYNGSVCVWNHETQTLVKTFEVCDLPVRAAKFVARKNWVVTGADDMQIRVFNYNTLERVHMFEAHSDYIRCIAVHPTQPFILTSS

SEQ ID NO: 17927 - protein, 118 aa, Homo sapiens
  Payload ID: 3603
  Gene Symbol: COPB2
  Gene Name: coatomer protein complex, subunit beta 2 (beta prime)
  ENSP ID: ENSP00000426682
  MOD_RES (1)..(1): Any amino acid
XLADPTEYENLFPGLKEAFVVEEWVKETHADLWPAKQYPLVTPNEERNVMEEGKDFQPSRSTAQQELDGKPASPTPVIVASHTANKEEKQPDPWPLEPTGHLDGARDTAGPSWLHHRF

SEQ ID NO: 17928 - protein, 86 aa, Homo sapiens
  Payload ID: 3603
  Gene Symbol: COPB2
  Gene Name: coatomer protein complex, subunit beta 2 (beta prime)
  ENSP ID: ENSP00000427185
MLASLYNGSVCVWNHETQTLVKTFEVCDLPVRAAKFVARKNWVVTGADDMQIRVFNYNTLERVHMFEAHSDYIRCIAVHPTQPFIL

SEQ ID NO: 17929 - protein, 308 aa, Homo sapiens
  Payload ID: 3604
  Gene Symbol: COPE
  Gene Name: coatomer protein complex, subunit epsilon
  Uniprot ID: O14579
  ENSP ID: ENSP00000262812
MAPPAPGPASGGSGEVDELFDVKNAFYIGSYQQCINEAQRVKLSSPERDVERDVFLYRAYLAQRKFGVVLDEIKPSSAPELQAVRMFADYLAHESRRDSIVAELDREMSRSVDVTNTTFLLMAASIYLHDQNPDAALRALHQGDSLECTAMTVQILLKLDRLDLARKELKRMQDLDEDATLTQLATAWVSLATGGEKLQDAYYIFQEMADKCSPTLLLLNGQAACHMAQGRWEAAEGLLQEALDKDSGYPETLVNLIVLSQHLGKPPEVTNRYLSQLKDAHRSHPFIKEYQAKENDFDRLVLQYAPSA

SEQ ID NO: 17930 - protein, 256 aa, Homo sapiens
  Payload ID: 3604
  Gene Symbol: COPE
  Gene Name: coatomer protein complex, subunit epsilon
  Uniprot ID: O14579
  ENSP ID: ENSP00000343134
MAPPAPGPASGGSGEVDELFDVKNAFYIGSYQQCINEAQRVKLSSPERDVERDVFLYRAYLAQRKFGVVLDEIKPSSAPELQAVRMFADYLAHESRRDSIVAELDREMSRSVDVTNTTFLLMAASIYLHDQNPDAALRALHQGDSLECTAMTVQILLKLDRLDLARKELKRMQDLDEDATLTQLATAWVSLATDSGYPETLVNLIVLSQHLGKPPEVTNRYLSQLKDAHRSHPFIKEYQAKENDFDRLVLQYAPSA

SEQ ID NO: 17931 - protein, 257 aa, Homo sapiens
  Payload ID: 3604
  Gene Symbol: COPE
  Gene Name: coatomer protein complex, subunit epsilon
  Uniprot ID: O14579
  ENSP ID: ENSP00000345674
MAPPAPGPASGGSGEVDELFDVKNAFYIGSYQQCINEAQRVKLSSPERDVERDVFLYRAYLAQRKFGVVLDEIKPSSAPELQAVRMFADYLAHESRSTAMTVQILLKLDRLDLARKELKRMQDLDEDATLTQLATAWVSLATGGEKLQDAYYIFQEMADKCSPTLLLLNGQAACHMAQGRWEAAEGLLQEALDKDSGYPETLVNLIVLSQHLGKPPEVTNRYLSQLKDAHRSHPFIKEYQAKENDFDRLVLQYAPSA

SEQ ID NO: 17932 - protein, 331 aa, Homo sapiens
  Payload ID: 3604
  Gene Symbol: COPE
  Gene Name: coatomer protein complex, subunit epsilon
  ENSP ID: ENSP00000469035
MAPPAPGPASGGSGEVDELFDVKNAFYIGSYQQCINEAQRVKLSSPERDVERDVFLYRAYLAQRKFGVVLDEIKPSSAPELQAVRMFADYLAHESRRDSIVAELDREMSRSVDVTNTTFLLMAASIYLHDQNPDAALRALHQGDSLEWVSSPGRALHLEAQPMEAASPDGRTAMTVQILLKLDRLDLARKELKRMQDLDEDATLTQLATAWVSLATGGEKLQDAYYIFQEMADKCSPTLLLLNGQAACHMAQGRWEAAEGLLQEALDKDSGYPETLVNLIVLSQHLGKPPEVTNRYLSQLKDAHRSHPFIKEYQAKENDFDRLVLQYAPSA

SEQ ID NO: 17933 - protein, 146 aa, Homo sapiens
  Payload ID: 3604
  Gene Symbol: COPE
  Gene Name: coatomer protein complex, subunit epsilon
  ENSP ID: ENSP00000471034
MAPPAPGPASGGSGEVDELFDVKNAFYIGSYQQCINEAQRVKLSSPERDVERDVFLYRAYLAQRKFGVVLDEIKPSSAPELQAVRMFADYLAHESRRVVRSCRMPTTSSRRWLTSARPPCCCSMGRRPATWPRAAGRPLRACCRRR

SEQ ID NO: 17934 - protein, 307 aa, Homo sapiens
  Payload ID: 3604
  Gene Symbol: COPE
  Gene Name: coatomer protein complex, subunit epsilon
  ENSP ID: ENSP00000483420
MAPPAPAGLRGSGEVDELFDVKNAFYIGSYQQCINEAQRVKLSSPERDVERDVFLYRAYLAQRKFGVVLDEIKPSSAPELQAVRMFADYLAHESRRDSIVAELDREMSRSVDVTNTTFLLMAASIYLHDQNPDAALRALHQGDSLECTAMTVQILLKLDRLDLARKELKRMQDLDEDATLTQLATAWVSLATGGEKLQDAYYIFQEMADKCSPTLLLLNGQAACHMAQGRWEAAEGLLQEALDKDSGYPETLVNLIVLSQHLGKPPEVTNRYLSQLKDAHRSHPFIKEYQAKENDFDRLVLQYAPSA

SEQ ID NO: 17935 - protein, 874 aa, Homo sapiens
  Payload ID: 3605
  Gene Symbol: COPG1
  Gene Name: coatomer protein complex, subunit gamma 1
  Uniprot ID: Q9Y678
  ENSP ID: ENSP00000325002
MLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLPSILVLLKRCVMDDDNEVRDRATFYLNVLEQKQKALNAGYILNGLTVSIPGLERALQQYTLEPSEKPFDLKSVPLATAPMAEQRTESTPITAVKQPEKVAATRQEIFQEQLAAVPEFRGLGPLFKSSPEPVALTESETEYVIRCTKHTFTNHMVFQFDCTNTLNDQTLENVTVQMEPTEAYEVLCYVPARSLPYNQPGTCYTLVALPKEDPTAVACTFSCMMKFTVKDCDPTTGETDDEGYEDEYVLEDLEVTVADHIQKVMKLNFEAAWDEVGDEFEKEETFTLSTIKTLEEAVGNIVKFLGMHPCERSDKVPDNKNTHTLLLAGVFRGGHDILVRSRLLLLDTVTMQVTARSLEELPVDIILASVG

SEQ ID NO: 17936 - protein, 76 aa, Homo sapiens
  Payload ID: 3605
  Gene Symbol: COPG1
  Gene Name: coatomer protein complex, subunit gamma 1
  ENSP ID: ENSP00000420916
  MOD_RES (1)..(1): Any amino acid
XMEPTEAYEVLCYVPARSLPYNQPGTCYTLVALPKEDPTAVACTFSCMMKFTVKDCDPTTGETDDEGYEDEYVSHS

SEQ ID NO: 17937 - protein, 188 aa, Homo sapiens
  Payload ID: 3605
  Gene Symbol: COPG1
  Gene Name: coatomer protein complex, subunit gamma 1
  ENSP ID: ENSP00000422478
  MOD_RES (1)..(1): Any amino acid
XITEWSWSMRSLPYNQPGTCYTLVALPKEDPTAVACTFSCMMKFTVKDCDPTTGETDDEGYEDEYVLEDLEVTVADHIQKVMKLNFEAAWDEVGDEFEKEETFTLSTIKTLEEAVGNIVKFLGMHPCERSDKVPDNKNTHTLLLAGVFRGGHDILVRSRLLLLDTVTMQVTARSLEELPVDIILASVG

SEQ ID NO: 17938 - protein, 49 aa, Homo sapiens
  Payload ID: 3605
  Gene Symbol: COPG1
  Gene Name: coatomer protein complex, subunit gamma 1
  ENSP ID: ENSP00000426457
MLKKFDKKDEESGGGSNPFQHLEKSAVLQEASDICSPLASIINIHHQCN

SEQ ID NO: 17939 - protein, 726 aa, Homo sapiens
  Payload ID: 3606
  Gene Symbol: COPG2
  Gene Name: coatomer protein complex, subunit gamma 2
  Uniprot ID: Q9UBF2
  ENSP ID: ENSP00000331218
MIKKFDKKDEESGSGSNPFQHLEKSAVLQEARIFNETPINPRRCLHILTKILYLLNQGEHFGTTEATEAFFAMTRLFQSNDQTLRRMCYLTIKEMATISEDVIIVTSSLTKDMTGKEDVYRGPAIRALCRITDGTMLQAIERYMKQAIVDKVSSVSSSALVSSLHMMKISYDVVKRWINEAQEAASSDNIMVQYHALGVLYHLRKNDRLAVSKMLNKFTKSGLKSQFAYCMLIRIASRLLKETEDGHESPLFDFIESCLRNKHEMVIYEAASAIIHLPNCTARELAPAVSVLQLFCSSPKPALRYAAVRTLNKVAMKHPSAVTACNLDLENLITDSNRSIATLAITTLLKTGSESSVDRLMKQISSFVSEISDEFKVVVVQAISALCQKYPRKHSVMMTFLSNMLRDDGGFEYKRAIVDCIISIVEENPESKEAGLAHLCEFIEDCEHTVLATKILHLLGKEGPRTPVPSKYIRFIFNRVVLENEAVRAAAVSALAKFGAQNESLLPSILVLLQRCMMDTDDEVRDRATFYLNVLQQRQMALNATYIFNGLTVSVPGMEKALHQYTLEPSEKPFDMKSIPLAMAPVFEQKAEITLVATKPEKLAPSRQDIFQEQLAAIPEFLNIGPLFKSSEPVQLTEAETEYFVRCIKHMFTNHIVFQFDCTNTLNDQLLEKVTVQMEPSDSYEVLSCIPAPSLPYNQPGICYTLVRLPDDDPTAGTNPQKGGDT

SEQ ID NO: 17940 - protein, 871 aa, Homo sapiens
  Payload ID: 3606
  Gene Symbol: COPG2
  Gene Name: coatomer protein complex, subunit gamma 2
  Uniprot ID: Q9UBF2
  ENSP ID: ENSP00000402346
MIKKFDKKDEESGSGSNPFQHLEKSAVLQEARIFNETPINPRRCLHILTKILYLLNQGEHFGTTEATEAFFAMTRLFQSNDQTLRRMCYLTIKEMATISEDVIIVTSSLTKDMTGKEDVYRGPAIRALCRITDGTMLQAIERYMKQAIVDKVSSVSSSALVSSLHMMKISYDVVKRWINEAQEAASSDNIMVQYHALGVLYHLRKNDRLAVSKMLNKFTKSGLKSQFAYCMLIRIASRLLKETEDGHESPLFDFIESCLRNKHEMVIYEAASAIIHLPNCTARELAPAVSVLQLFCSSPKPALRYAAVRTLNKVAMKHPSAVTACNLDLENLITDSNRSIATLAITTLLKTGSESSVDRLMKQISSFVSEISDEFKVVVVQAISALCQKYPRKHSVMMTFLSNMLRDDGGFEYKRAIVDCIISIVEENPESKEAGLAHLCEFIEDCEHTVLATKILHLLGKEGPRTPVPSKYIRFIFNRVVLENEAVRAAAVSALAKFGAQNESLLPSILVLLQRCMMDTDDEVRDRATFYLNVLQQRQMALNATYIFNGLTVSVPGMEKALHQYTLEPSEKPFDMKSIPLAMAPVFEQKAEITLVATKPEKLAPSRQDIFQEQLAAIPEFLNIGPLFKSSEPVQLTEAETEYFVRCIKHMFTNHIVFQFDCTNTLNDQLLEKVTVQMEPSDSYEVLSCIPAPSLPYNQPGICYTLVRLPDDDPTAVAGSFSCTMKFTVRDCDPNTGVPDEDGYDDEYVLEDLEVTVSDHIQKVLKPNFAAAWEEVGDTFEKEETFALSSTKTLEEAVNNIITFLGMQPCERSDKVPENKNSHSLYLAGIFRGGYDLLVRSRLALADGVTMQVTVRSKERTPVDVILASVG

SEQ ID NO: 17941 - protein, 177 aa, Homo sapiens
  Payload ID: 3607
  Gene Symbol: COPZ1
  Gene Name: coatomer protein complex, subunit zeta 1
  Uniprot ID: P61923
  ENSP ID: ENSP00000262061
MEALILEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 17942 - protein, 154 aa, Homo sapiens
  Payload ID: 3607
  Gene Symbol: COPZ1
  Gene Name: coatomer protein complex, subunit zeta 1
  Uniprot ID: P61923
  ENSP ID: ENSP00000410620
MEALILYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 17943 - protein, 107 aa, Homo sapiens
  Payload ID: 3607
  Gene Symbol: COPZ1
  Gene Name: coatomer protein complex, subunit zeta 1
  ENSP ID: ENSP00000447100
MEALILEPSLYTVKAILILDNDGDRLFAKYYDDTYPSVKEQKAFEKNIFNKTHRTDSEIALLEGLTVVYKSSIDLYFYVIGSSYENEEKCRKASTAGEHGGAVLGCG

SEQ ID NO: 17944 - protein, 95 aa, Homo sapiens
  Payload ID: 3607
  Gene Symbol: COPZ1
  Gene Name: coatomer protein complex, subunit zeta 1
  ENSP ID: ENSP00000448005
MEALILEPSLYTVKAILILDNDGDRLFAKYYDDTYPSVKEQKAFEKNIFNKTHRTDTDAYGCSELSLRLIEPDAEEKCRKASTAGEHGGAVLGCG

SEQ ID NO: 17945 - protein, 119 aa, Homo sapiens
  Payload ID: 3607
  Gene Symbol: COPZ1
  Gene Name: coatomer protein complex, subunit zeta 1
  ENSP ID: ENSP00000448235
MEALILEPSLYTVKAILILDNDGDRLFAKLMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 17946 - protein, 160 aa, Homo sapiens
  Payload ID: 3607
  Gene Symbol: COPZ1
  Gene Name: coatomer protein complex, subunit zeta 1
  Uniprot ID: P61923
  ENSP ID: ENSP00000448444
MEALILEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVLQSAKEQIKWSLLR

SEQ ID NO: 17947 - protein, 89 aa, Homo sapiens
  Payload ID: 3607
  Gene Symbol: COPZ1
  Gene Name: coatomer protein complex, subunit zeta 1
  ENSP ID: ENSP00000448945
MLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 17948 - protein, 164 aa, Homo sapiens
  Payload ID: 3607
  Gene Symbol: COPZ1
  Gene Name: coatomer protein complex, subunit zeta 1
  ENSP ID: ENSP00000448997
MEALILYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVYLFSLHPLSGFEFFWNFPNNLLGP

SEQ ID NO: 17949 - protein, 138 aa, Homo sapiens
  Payload ID: 3607
  Gene Symbol: COPZ1
  Gene Name: coatomer protein complex, subunit zeta 1
  ENSP ID: ENSP00000449072
MGGFRTEGMFVSLQEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVD

SEQ ID NO: 17950 - protein, 163 aa, Homo sapiens
  Payload ID: 3607
  Gene Symbol: COPZ1
  Gene Name: coatomer protein complex, subunit zeta 1
  ENSP ID: ENSP00000449108
MEALILEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQV

SEQ ID NO: 17951 - protein, 185 aa, Homo sapiens
  Payload ID: 3607
  Gene Symbol: COPZ1
  Gene Name: coatomer protein complex, subunit zeta 1
  Uniprot ID: P61923
  ENSP ID: ENSP00000449270
MGGFRTEGMFVSLQEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 17952 - protein, 198 aa, Homo sapiens
  Payload ID: 3607
  Gene Symbol: COPZ1
  Gene Name: coatomer protein complex, subunit zeta 1
  ENSP ID: ENSP00000449341
MEALILEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRTGSTQAGGLHESSSRQAWATQKNVEKRALLENMEGLFLAVDEIVDGGVILESDPQQVVHRVALRGEDVPLTEQTVSQVLQSAKEQIKWSLLR

SEQ ID NO: 17953 - protein, 92 aa, Homo sapiens
  Payload ID: 3607
  Gene Symbol: COPZ1
  Gene Name: coatomer protein complex, subunit zeta 1
  ENSP ID: ENSP00000449414
MEALILEPSLYTVKAILILDNDGDRLFAKYYDDTYPSVKEQKAFEKNIFNKTHRTDSEIALLEGLTVVYKSSIDLYFYVIGSSYENELMLMA

SEQ ID NO: 17954 - protein, 141 aa, Homo sapiens
  Payload ID: 3608
  Gene Symbol: COPZ2
  Gene Name: coatomer protein complex, subunit zeta 2
  ENSP ID: ENSP00000462035
  MOD_RES (1)..(1): Any amino acid
XTIKAVFILDNDGRRLLAKYYDDTFPSMKEQMVFEKNVFNKTSRTESEIAFFGGMTIVYKNSIDLFLYVVGSSYENELMLMSVLTCLFESLNHMLSVILESDPQQVIQKVNFRADDGGLTEQSVAQVLQSAKEQIKWSLLK

SEQ ID NO: 17955 - protein, 45 aa, Homo sapiens
  Payload ID: 3608
  Gene Symbol: COPZ2
  Gene Name: coatomer protein complex, subunit zeta 2
  ENSP ID: ENSP00000463413
DLFLYVVGSSYENEEERGEALVAGEHGRSLLGAGRDCGWRCDSGE

SEQ ID NO: 17956 - protein, 9 aa, Homo sapiens
  Payload ID: 3608
  Gene Symbol: COPZ2
  Gene Name: coatomer protein complex, subunit zeta 2
  ENSP ID: ENSP00000463581
MKEQMVFEK

SEQ ID NO: 17957 - protein, 56 aa, Homo sapiens
  Payload ID: 3608
  Gene Symbol: COPZ2
  Gene Name: coatomer protein complex, subunit zeta 2
  ENSP ID: ENSP00000463687
  MOD_RES (1)..(1): Any amino acid
XIKAVFILDNDGRRLLAKYYDDTFPSMKEQMVFEKNVFNKTSRTETDAHVCSHLPV

SEQ ID NO: 17958 - protein, 79 aa, Homo sapiens
  Payload ID: 3608
  Gene Symbol: COPZ2
  Gene Name: coatomer protein complex, subunit zeta 2
  ENSP ID: ENSP00000463841
RTESEIAFFGGMTIVYKNSIDLFLYVVGSSYENELMLMSVLTCLFESLNHMLRKNVEKRWLLENMDGAFLVLDEIVDGG

SEQ ID NO: 17959 - protein, 116 aa, Homo sapiens
  Payload ID: 3608
  Gene Symbol: COPZ2
  Gene Name: coatomer protein complex, subunit zeta 2
  ENSP ID: ENSP00000464484
GMTIVYKNSIDLFLYVVGSSYENELMLMSVLTCLFESLNHMLRKNVEKRWLLENMDGAFLVLDEIVDGGVILESDPQQVIQKVNFRADDGGLTEQSVAQVSLLRLILLVWNFPPWR

SEQ ID NO: 17960 - protein, 210 aa, Homo sapiens
  Payload ID: 3608
  Gene Symbol: COPZ2
  Gene Name: coatomer protein complex, subunit zeta 2
  Uniprot ID: Q9P299
  ENSP ID: ENSP00000480707
MQRPEAWPRPHPGEGAAAAQAGGPAPPARAGEPSGLRLQEPSLYTIKAVFILDNDGRRLLAKYYDDTFPSMKEQMVFEKNVFNKTSRTESEIAFFGGMTIVYKNSIDLFLYVVGSSYENELMLMSVLTCLFESLNHMLRKNVEKRWLLENMDGAFLVLDEIVDGGVILESDPQQVIQKVNFRADDGGLTEQSVAQVLQSAKEQIKWSLLK

SEQ ID NO: 17961 - protein, 359 aa, Homo sapiens
  Payload ID: 3609
  Gene Symbol: CBWD1
  Gene Name: COBW domain containing 1
  Uniprot ID: Q9BRT8
  ENSP ID: ENSP00000323433
MYFKRAARAFPVLLTGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 17962 - protein, 395 aa, Homo sapiens
  Payload ID: 3609
  Gene Symbol: CBWD1
  Gene Name: COBW domain containing 1
  Uniprot ID: Q9BRT8
  ENSP ID: ENSP00000348915
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 17963 - protein, 395 aa, Homo sapiens; identical to SEQ ID NO: 17962
  Payload ID: 3609
  Gene Symbol: CBWD1
  Gene Name: COBW domain containing 1
  Uniprot ID: Q9BRT8
  ENSP ID: ENSP00000366617

SEQ ID NO: 17964 - protein, 250 aa, Homo sapiens
  Payload ID: 3609
  Gene Symbol: CBWD1
  Gene Name: COBW domain containing 1
  ENSP ID: ENSP00000366666
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRYEMISVLSAYRSMLYTQNIFYSDCCPVET

SEQ ID NO: 17965 - protein, 77 aa, Homo sapiens
  Payload ID: 3609
  Gene Symbol: CBWD1
  Gene Name: COBW domain containing 1
  ENSP ID: ENSP00000371826
MYFKRAARAFPVLLTGAGKTTLLNYILTEQHSKRVAVILNEFGEGSALEKSLAVSQGGELYEEWLELRNGCLCCSVK

SEQ ID NO: 17966 - protein, 113 aa, Homo sapiens
  Payload ID: 3609
  Gene Symbol: CBWD1
  Gene Name: COBW domain containing 1
  Uniprot ID: Q9BRT8
  ENSP ID: ENSP00000371830
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVK

SEQ ID NO: 17967 - protein, 376 aa, Homo sapiens
  Payload ID: 3609
  Gene Symbol: CBWD1
  Gene Name: COBW domain containing 1
  Uniprot ID: Q9BRT8
  ENSP ID: ENSP00000371885
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 17968 - protein, 38 aa, Homo sapiens
  Payload ID: 3609
  Gene Symbol: CBWD1
  Gene Name: COBW domain containing 1
  ENSP ID: ENSP00000477647
  MOD_RES (1)..(1): Any amino acid
XGAVASMFWVDAELGSDIYLDGIITIVDSKYGLKVKYH

SEQ ID NO: 17969 - protein, 160 aa, Homo sapiens
  Payload ID: 3609
  Gene Symbol: CBWD1
  Gene Name: COBW domain containing 1
  ENSP ID: ENSP00000477749
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGIITIVDSKYGLKVKYH

SEQ ID NO: 17970 - protein, 93 aa, Homo sapiens
  Payload ID: 3609
  Gene Symbol: CBWD1
  Gene Name: COBW domain containing 1
  ENSP ID: ENSP00000478349
  MOD_RES (1)..(1): Any amino acid
XLDLHAFDSLSGISLQKKLQHVPGTQPHLDQSIVTITFEVPGNAKEEHLNMFIQNLLWEKNVRNKDNHCMEVIRLKVQFTVADFRTKSFSWLL

SEQ ID NO: 17971 - protein, 50 aa, Homo sapiens
  Payload ID: 3609
  Gene Symbol: CBWD1
  Gene Name: COBW domain containing 1
  ENSP ID: ENSP00000479698
ELYEEWLELRNGCLCCSVKDSGLRAIENLMQKKGKFDYILLETTGLADPE

SEQ ID NO: 17972 - protein, 38 aa, Homo sapiens; identical to SEQ ID NO: 17968
  Payload ID: 3609
  Gene Symbol: CBWD1
  Gene Name: COBW domain containing 1
  ENSP ID: ENSP00000480295
  MOD_RES (1)..(1): Any amino acid

SEQ ID NO: 17973 - protein, 58 aa, Homo sapiens
  Payload ID: 3609
  Gene Symbol: CBWD1
  Gene Name: COBW domain containing 1
  ENSP ID: ENSP00000481562
MLPAVGSADEEEDPAEEDCPELVPIETTQSEEEEKSGLGAKIPVTIITGYLVIQRLLC

SEQ ID NO: 17974 - protein, 160 aa, Homo sapiens; identical to SEQ ID NO: 17969
  Payload ID: 3609
  Gene Symbol: CBWD1
  Gene Name: COBW domain containing 1
  ENSP ID: ENSP00000482298

SEQ ID NO: 17975 - protein, 180 aa, Homo sapiens
  Payload ID: 3609
  Gene Symbol: CBWD1
  Gene Name: COBW domain containing 1
  ENSP ID: ENSP00000482821
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKVKYH

SEQ ID NO: 17976 - protein, 28 aa, Homo sapiens
  Payload ID: 3609
  Gene Symbol: CBWD1
  Gene Name: COBW domain containing 1
  ENSP ID: ENSP00000483746
  MOD_RES (1)..(1): Any amino acid
XAELGSDIYLDGIITIVDSKYGLKVKYH

SEQ ID NO: 17977 - protein, 347 aa, Homo sapiens
  Payload ID: 3609
  Gene Symbol: CBWD1
  Gene Name: COBW domain containing 1
  ENSP ID: ENSP00000483870
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 17978 - protein, 19 aa, Homo sapiens
  Payload ID: 3609
  Gene Symbol: CBWD1
  Gene Name: COBW domain containing 1
  ENSP ID: ENSP00000484540
  MOD_RES (1)..(1): Any amino acid
XPLKAEKNEIIPPTDPFPI

SEQ ID NO: 17979 - protein, 395 aa, Homo sapiens
  Payload ID: 3610
  Gene Symbol: CBWD2
  Gene Name: COBW domain containing 2
  Uniprot ID: Q8IUF1
  ENSP ID: ENSP00000259199
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLAEEKPDGLINEATRQVALADAILINKTDLVPEEDVKKLRATIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTHFKEDQVCT

SEQ ID NO: 17980 - protein, 58 aa, Homo sapiens
  Payload ID: 3610
  Gene Symbol: CBWD2
  Gene Name: COBW domain containing 2
  ENSP ID: ENSP00000351418
MLPAVGSADEEEDPAEEDCPELVPMETTQSEEEEKSGLGAKIPVTIITGYLVIQRLLC

SEQ ID NO: 17981 - protein, 182 aa, Homo sapiens
  Payload ID: 3610
  Gene Symbol: CBWD2
  Gene Name: COBW domain containing 2
  ENSP ID: ENSP00000393105
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKAKNWTT

SEQ ID NO: 17982 - protein, 180 aa, Homo sapiens [sequence omitted]

SEQ ID NO: 17983 - protein, 376 aa, Homo sapiens
  Payload ID: 3610
  Gene Symbol: CBWD2
  Gene Name: COBW domain containing 2
  ENSP ID: ENSP00000411906
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLAEEKPDGLINEATRQVALADAILINKTDLVPEEDVKKLRATIRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTHFKEDQVCT

SEQ ID NO: 17984 - protein, 395 aa, Homo sapiens
  Payload ID: 3611
  Gene Symbol: CBWD3
  Gene Name: COBW domain containing 3
  Uniprot ID: Q5JTY5
  ENSP ID: ENSP00000353295
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 17985 - protein, 376 aa, Homo sapiens
  Payload ID: 3611
  Gene Symbol: CBWD3
  Gene Name: COBW domain containing 3
  ENSP ID: ENSP00000366559
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTIRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 17986 - protein, 160 aa, Homo sapiens
  Payload ID: 3611
  Gene Symbol: CBWD3
  Gene Name: COBW domain containing 3
  ENSP ID: ENSP00000366561
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGIITIVDSKYGLKVKYH

SEQ ID NO: 17987 - protein, 58 aa, Homo sapiens
  Payload ID: 3611
  Gene Symbol: CBWD3
  Gene Name: COBW domain containing 3
  ENSP ID: ENSP00000366566
MLPAVGSVDEEEDPAEEDCPELVPIETTQSEEEEKSGLGAKIPVTIITGYLVIQRLLY

SEQ ID NO: 17988 - protein, 113 aa, Homo sapiens
  Payload ID: 3611
  Gene Symbol: CBWD3
  Gene Name: COBW domain containing 3
  ENSP ID: ENSP00000475010
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVK

SEQ ID NO: 17989 - protein, 58 aa, Homo sapiens; identical to SEQ ID NO: 17987
  Payload ID: 3611
  Gene Symbol: CBWD3
  Gene Name: COBW domain containing 3
  ENSP ID: ENSP00000478468

SEQ ID NO: 17990 - protein, 180 aa, Homo sapiens
  Payload ID: 3611
  Gene Symbol: CBWD3
  Gene Name: COBW domain containing 3
  ENSP ID: ENSP00000479332
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKVKYH

SEQ ID NO: 17991 - protein, 347 aa, Homo sapiens
  Payload ID: 3611
  Gene Symbol: CBWD3
  Gene Name: COBW domain containing 3
  ENSP ID: ENSP00000480203
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 17992 - protein, 180 aa, Homo sapiens; identical to SEQ ID NO: 17990
  Payload ID: 3611
  Gene Symbol: CBWD3
  Gene Name: COBW domain containing 3
  ENSP ID: ENSP00000481598

SEQ ID NO: 17993 - protein, 182 aa, Homo sapiens
  Payload ID: 3611
  Gene Symbol: CBWD3
  Gene Name: COBW domain containing 3
  ENSP ID: ENSP00000481705
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKAKNWTT

SEQ ID NO: 17994 - protein, 58 aa, Homo sapiens; identical to SEQ ID NO: 17987
  Payload ID: 3611
  Gene Symbol: CBWD3
  Gene Name: COBW domain containing 3
  ENSP ID: ENSP00000482522

SEQ ID NO: 17995 - protein, 58 aa, Homo sapiens; identical to SEQ ID NO: 17987
  Payload ID: 3611
  Gene Symbol: CBWD3
  Gene Name: COBW domain containing 3
  ENSP ID: ENSP00000483861

SEQ ID NO: 17996 - protein, 180 aa, Homo sapiens; identical to SEQ ID NO: 17990
  Payload ID: 3611
  Gene Symbol: CBWD3
  Gene Name: COBW domain containing 3
  ENSP ID: ENSP00000484719

SEQ ID NO: 17997 - protein, 113 aa, Homo sapiens; identical to SEQ ID NO: 17988
  Payload ID: 3612
  Gene Symbol: CBWD5
  Gene Name: COBW domain containing 5
  ENSP ID: ENSP00000366601

SEQ ID NO: 17998 - protein, 58 aa, Homo sapiens; identical to SEQ ID NO: 17987
  Payload ID: 3612
  Gene Symbol: CBWD5
  Gene Name: COBW domain containing 5
  ENSP ID: ENSP00000366606

SEQ ID NO: 17999 - protein, 176 aa, Homo sapiens
  Payload ID: 3612
  Gene Symbol: CBWD5
  Gene Name: COBW domain containing 5
  ENSP ID: ENSP00000366609
MYFTEFPTAHVSFLPFRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 18000 - protein, 347 aa, Homo sapiens
  Payload ID: 3612
  Gene Symbol: CBWD5
  Gene Name: COBW domain containing 5
  Uniprot ID: Q5RIA9
  ENSP ID: ENSP00000366612
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVTSMFWVDAELGSDIYLDGIITIVDSKYGLKHLTEEKPDGLINEATRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 18001 - protein, 395 aa, Homo sapiens
  Payload ID: 3612
  Gene Symbol: CBWD5
  Gene Name: COBW domain containing 5
  Uniprot ID: Q5RIA9
  ENSP ID: ENSP00000371842
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVTSMFWVDAELGSDIYLDGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 18002 - protein, 376 aa, Homo sapiens
  Payload ID: 3612
  Gene Symbol: CBWD5
  Gene Name: COBW domain containing 5
  ENSP ID: ENSP00000397999
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVTSMFWVDAELGSDIYLDGIITIVDSKYGLKHLTEEKPDGLINEATRQVALADIILINKTDLVPEEDVKKLRTTIRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 18003 - protein, 375 aa, Homo sapiens
  Payload ID: 3612
  Gene Symbol: CBWD5
  Gene Name: COBW domain containing 5
  ENSP ID: ENSP00000405076
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 18004 - protein, 177 aa, Homo sapiens
  Payload ID: 3612
  Gene Symbol: CBWD5
  Gene Name: COBW domain containing 5
  ENSP ID: ENSP00000417466
  MOD_RES (1)..(1): Any amino acid
XTDLVPEEDVKKLRTTIRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 18005 - protein, 58 aa, Homo sapiens; identical to SEQ ID NO: 17987
  Payload ID: 3612
  Gene Symbol: CBWD5
  Gene Name: COBW domain containing 5
  ENSP ID: ENSP00000417957

SEQ ID NO: 18006 - protein, 160 aa, Homo sapiens; identical to SEQ ID NO: 17986
  Payload ID: 3612
  Gene Symbol: CBWD5
  Gene Name: COBW domain containing 5
  ENSP ID: ENSP00000418163

SEQ ID NO: 18007 - protein, 180 aa, Homo sapiens
  Payload ID: 3612
  Gene Symbol: CBWD5
  Gene Name: COBW domain containing 5
  ENSP ID: ENSP00000419839
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVTSMFWVDAELGSDIYLDGIITIVDSKYGLKVKYH

SEQ ID NO: 18008 - protein, 180 aa, Homo sapiens; identical to SEQ ID NO: 18007
  Payload ID: 3612
  Gene Symbol: CBWD5
  Gene Name: COBW domain containing 5
  ENSP ID: ENSP00000420033

SEQ ID NO: 18009 - protein, 182 aa, Homo sapiens
  Payload ID: 3612
  Gene Symbol: CBWD5
  Gene Name: COBW domain containing 5
  ENSP ID: ENSP00000420326
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVTSMFWVDAELGSDIYLDGIITIVDSKYGLKAKNWTT

SEQ ID NO: 18010 - protein, 58 aa, Homo sapiens; identical to SEQ ID NO: 17987
  Payload ID: 3612
  Gene Symbol: CBWD5
  Gene Name: COBW domain containing 5
  ENSP ID: ENSP00000420334

SEQ ID NO: 18011 - protein, 395 aa, Homo sapiens
  Payload ID: 3613
  Gene Symbol: CBWD7
  Gene Name: COBW domain containing 7
  Uniprot ID: A6NM15
  ENSP ID: ENSP00000366608
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTLRSINGLGQILETQRSRVDLSNVLDLHAFDSLSGISLQKKLQHVPGTQPHLDQSIVTITFDVPGNAKEEHLNMFIQNLLWEKNVRNKDNHCMEVIRLKGLVSIKDKSQQVIVQGVHELCDLEETPVSWKDDTERTNRLVLIGRNLDKDILKQLFIATVTETEKQWTTHFKEDQVCT

SEQ ID NO: 18012 - protein, 376 aa, Homo sapiens
  Payload ID: 3613
  Gene Symbol: CBWD7
  Gene Name: COBW domain containing 7
  ENSP ID: ENSP00000401079
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTLRSINGLGQILETQRSSLQKKLQHVPGTQPHLDQSIVTITFDVPGNAKEEHLNMFIQNLLWEKNVRNKDNHCMEVIRLKGLVSIKDKSQQVIVQGVHELCDLEETPVSWKDDTERTNRLVLIGRNLDKDILKQLFIATVTETEKQWTTHFKEDQVCT

SEQ ID NO: 18013 - protein, 73 aa, Homo sapiens
  Payload ID: 3613
  Gene Symbol: CBWD7
  Gene Name: COBW domain containing 7
  ENSP ID: ENSP00000478412
CSVKDNGLRAIENLMQKKGKFDDILLETTGLADPGAVASMFWVDAELGSDIYLDGIITIVDSKYGLKAKNWTT

SEQ ID NO: 18014 - protein, 46 aa, Homo sapiens
  Payload ID: 3613
  Gene Symbol: CBWD7
  Gene Name: COBW domain containing 7
  ENSP ID: ENSP00000480830
  MOD_RES (1)..(1): Any amino acid
XTGLADPGAVASMFWVDAELGSDIYLDGIITIVDSKYGLKAKNWTT

SEQ ID NO: 18015 - protein, 180 aa, Homo sapiens; identical to SEQ ID NO: 17990
  Payload ID: 3613
  Gene Symbol: CBWD7
  Gene Name: COBW domain containing 7
  ENSP ID: ENSP00000480837

SEQ ID NO: 18016 - protein, 180 aa, Homo sapiens; identical to SEQ ID NO: 17990
  Payload ID: 3613
  Gene Symbol: CBWD7
  Gene Name: COBW domain containing 7
  ENSP ID: ENSP00000481300

SEQ ID NO: 18017 - protein, 359 aa, Homo sapiens
  Payload ID: 3613
  Gene Symbol: CBWD7
  Gene Name: COBW domain containing 7
  ENSP ID: ENSP00000482804
MYFKRAPRAFPVLLTGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTLRSINGLGQILETQRSRVDLSNVLDLHAFDSLSGISLQKKLQHVPGTQPHLDQSIVTITFDVPGNAKEEHLNMFIQNLLWEKNVRNKDNHCMEVIRLKGLVSIKDKSQQVIVQGVHELCDLEETPVSWKDDTERTNRLVLIGRNLDKDILKQLFIATVTETEKQWTTHFKEDQVCT

SEQ ID NO: 18018 - protein, 137 aa, Homo sapiens
  Payload ID: 3613
  Gene Symbol: CBWD7
  Gene Name: COBW domain containing 7
  ENSP ID: ENSP00000484049
  MOD_RES (1)..(1): Any amino acid
XTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKVKYH

SEQ ID NO: 18019 - protein, 160 aa, Homo sapiens; identical to SEQ ID NO: 17986
  Payload ID: 3613
  Gene Symbol: CBWD7
  Gene Name: COBW domain containing 7
  ENSP ID: ENSP00000484231

SEQ ID NO: 18020 - protein, 550 aa, Homo sapiens
  Payload ID: 3614
  Gene Symbol: COCH
  Gene Name: cochlin
  Uniprot ID: O43405
  ENSP ID: ENSP00000216361
MSAAWIPALGLGVCLLLLPGPAGSEGAAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 18021 - protein, 550 aa, Homo sapiens; identical to SEQ ID NO: 18020
  Payload ID: 3614
  Gene Symbol: COCH
  Gene Name: cochlin
  Uniprot ID: O43405
  ENSP ID: ENSP00000379862

SEQ ID NO: 18022 - protein, 494 aa, Homo sapiens
  Payload ID: 3614
  Gene Symbol: COCH
  Gene Name: cochlin
  Uniprot ID: O43405
  ENSP ID: ENSP00000451528
MSAAWIPALGLGVCLLLLPGPAGSEGAAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAAK

SEQ ID NO: 18023 - protein, 55 aa, Homo sapiens
  Payload ID: 3614
  Gene Symbol: COCH
  Gene Name: cochlin
  ENSP ID: ENSP00000451629
PIAITCFTRGLDIRKEKADVLCPGGCPLEEFSVYGNIVYASVSSICGAAVHRRQK

SEQ ID NO: 18024 - protein, 438 aa, Homo sapiens
  Payload ID: 3614
  Gene Symbol: COCH
  Gene Name: cochlin
  ENSP ID: ENSP00000451713
MLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 18025 - protein, 434 aa, Homo sapiens
  Payload ID: 3614
  Gene Symbol: COCH
  Gene Name: cochlin
  ENSP ID: ENSP00000452284
  MOD_RES (1)..(1): Any amino acid
XCKADIAFLIDGSFNIGQRRFNLQKNFVGKVALMLGIGTEGPHVGLVQASEHPKIEFYLKNFTSAKDVLFAIKEVGFRGGNSNTDITLEKYLFVMLKRSENQQTYLMNADVAERMSSTTVDSEERLLRGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 18026 - protein, 80 aa, Homo sapiens
  Payload ID: 3614
  Gene Symbol: COCH
  Gene Name: cochlin
  ENSP ID: ENSP00000452343
MSAAWIPALGLGVCLLLLPGPAGSEGAAPIAITCFTRGLDIRKEKADVLCPGGCPLEEFSVYGNIVYASVSSICGAAVHR

SEQ ID NO: 18027 - protein, 193 aa, Homo sapiens
  Payload ID: 3614
  Gene Symbol: COCH
  Gene Name: cochlin
  ENSP ID: ENSP00000452541
MSAAWIPALGLAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQA

SEQ ID NO: 18028 - protein, 202 aa, Homo sapiens
  Payload ID: 3614
  Gene Symbol: COCH
  Gene Name: cochlin
  ENSP ID: ENSP00000452569
MSAAWIPALGLGVCLLLLPGPAGSEGAGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDK

SEQ ID NO: 18029 - protein, 1227 aa, Homo sapiens
  Payload ID: 3615
  Gene Symbol: CDAN1
  Gene Name: codanin 1
  Uniprot ID: Q8IWY9
  ENSP ID: ENSP00000348564
MAAVLESLLREEVSVAAVVRWIARSTQGSEDNAGEAAALSSLRALRKEFVPFLLNFLREQSSRVLPQGPPTPAKTPGASAALPGRPGGPPRGSRGARSQLFPPTEAQSTAAEAPLARRGGRRRGPGPARERGGRGLEEGVSGESLPGAGGRRLRGSGSPSRPSLTLSDPPNLSNLEEFPPVGSVPPGPTGTKPSRRINPTPVSEERSLSKPKTCFTSPPISCVPSSQPSALDTSPWGLGLPPGCRSLQEEREMLRKERSKQLQQSPTPTCPTPELGSPLPSRTGSLTDEPADPARVSSRQRLELVALVYSSCIAENLVPNLFLELFFVFQLLTARRMVTAKDSDPELSPAVLDSLESPLFQSIHDCVFFAVQVLECHFQVLSNLDKGTLKLLAENERLLCFSPALQGRLRAAYEGSVAKVSLVMPPSTQAVSFQPETDNRANFSSDRAFHTFKKQRDVFYEVLREWEDHHEEPGWDFEKGLGSRIRAMMGQLSAACSHSHFVRLFQKQLLQMCQSPGGAGGTVLGEAPDVLSMLGADKLGRLWRLQERLMAPQSSGGPCPPPTFPGCQGFFRDFILSASSFQFNQHLMDSLSLKIQELNGLALPQHEPNDEDGESDVDWQGERKQFAVVLLSLRLLAKFLGFVAFLPYRGPEPPPTGELQDSILALRSQVPPVLDVRTLLQRGLQARRAVLTVPWLVEFLSFADHVVPLLEYYRDIFTLLLRLHRSLVLSQESEGKMCFLNKLLLLAVLGWLFQIPTVPEDLFFLEEGPSYAFEVDTVAPEHGLDNAPVVDQQLLYTCCPYIGELRKLLASWVSGSSGRSGGFMRKITPTTTTSLGAQPSQTSQGLQAQLAQAFFHNQPPSLRRTVEFVAERIGSNCVKHIKATLVADLVRQAESLLQEQLVTQGEEGGDPAQLLEILCSQLCPHGAQALALGREFCQRKSPGAVRALLPEETPAAVLSSAENIAVGLATEKACAWLSANITALIRREVKAAVSRTLRAQGPEPAARGERRGCSRACEHHAPLPSHLISEIKDVLSLAVGPRDPDEGVSPEHLEQLLGQLGQTLRCRQFLCPPAEQHLAKCSVELASLLVADQIPILGPPAQYRLERGQARRLLHMLLSLWKEDFQGPVPLQLLLSPRNVGLLADTRPREWDLLLFLLRELVEKGLMGRMEIEACLGSLHQAQWPGDFAEELATLSNLFLAEPHLPEPQLRACELVQPNRGTVLAQS

SEQ ID NO: 18030 - protein, 347 aa, Homo sapiens
  Payload ID: 3615
  Gene Symbol: CDAN1
  Gene Name: codanin 1
  ENSP ID: ENSP00000454246
VPPVLDVRTLLQRGLQARRAVLTVPWLVEFLSFADHVVPLLEYYRDIFTLLLRLHRSLVLSQESEGKMCFLNKLLLLAVLGWLFQIPTVPEDLFFLEEGPSYAFEVDTVAPEHGLDNAPVVDQQLLYTCCPYIGELRKLLASWVSGSSGRSGGFMRKITPTTTTSLGAQPSQTSQGLQAQLAQAFFHNQPPSLRRTVEFVAERIGSNCVKHIKATLVADLVRQAESLLQEQLVTQGEEGGDPAQLLEILCSQLCPHGAQALALGREFCQRKSPGAVRALLPEETPAAVLSSAENIAVGLATEKACAWLSANITALIRREVKAAVSRTLRAQGPEPAARGERRGCSRA

SEQ ID NO: 18031 - protein, 95 aa, Homo sapiens
  Payload ID: 3615
  Gene Symbol: CDAN1
  Gene Name: codanin 1
  ENSP ID: ENSP00000455536
AVVRWIARSTQGSEVTAVTRPQDNAGEAAALSSLRALRKEFVPFLLNFLREQSSRVLPQGPPTPAKTPGASAALPGRPGGPPRGSRGARSQLFPP

SEQ ID NO: 18032 - protein, 247 aa, Homo sapiens
  Payload ID: 3616
  Gene Symbol: COQ10A
  Gene Name: coenzyme Q10A
  Uniprot ID: Q96MF6
  ENSP ID: ENSP00000312587
MAWAGSRRVPAGTRAAAERCCRLSLSPGAQPAPPPGPLPPPRPMRFLTSCSLLLPRAAQILAAEAGLPSSRSFMGFAAPFTNKRKAYSERRIMGYSMQEMYEVVSNVQEYREFVPWCKKSLVVSSRKGHLKAQLEVGFPPVMERYTSAVSMVKPHMVKAVCTDGKLFNHLETIWRFSPGIPAYPRTCTVDFSISFEFRSLLHSQLATMFFDEVVKQNVAAFERRAATKFGPETAIPRELMFHEVHQT

SEQ ID NO: 18033 - protein, 215 aa, Homo sapiens
  Payload ID: 3616
  Gene Symbol: COQ10A
  Gene Name: coenzyme Q10A
  Uniprot ID: Q96MF6
  ENSP ID: ENSP00000407843
MLLQVVREGKFSGFLTSCSLLLPRAAQILAAEAGLPSSRSFMGFAAPFTNKRKAYSERRIMGYSMQEMYEVVSNVQEYREFVPWCKKSLVVSSRKGHLKAQLEVGFPPVMERYTSAVSMVKPHMVKAVCTDGKLFNHLETIWRFSPGIPAYPRTCTVDFSISFEFRSLLHSQLATMFFDEVVKQNVAAFERRAATKFGPETAIPRELMFHEVHQT

SEQ ID NO: 18034 - protein, 230 aa, Homo sapiens
  Payload ID: 3616
  Gene Symbol: COQ10A
  Gene Name: coenzyme Q10A
  Uniprot ID: Q96MF6
  ENSP ID: ENSP00000446723
MHSSSPSPTNDRGLRRTIRLAPLSFGLRFLTSCSLLLPRAAQILAAEAGLPSSRSFMGFAAPFTNKRKAYSERRIMGYSMQEMYEVVSNVQEYREFVPWCKKSLVVSSRKGHLKAQLEVGFPPVMERYTSAVSMVKPHMVKAVCTDGKLFNHLETIWRFSPGIPAYPRTCTVDFSISFEFRSLLHSQLATMFFDEVVKQNVAAFERRAATKFGPETAIPRELMFHEVHQT

SEQ ID NO: 18035 - protein, 153 aa, Homo sapiens
  Payload ID: 3616
  Gene Symbol: COQ10A
  Gene Name: coenzyme Q10A
  ENSP ID: ENSP00000446957
  MOD_RES (1)..(1): Any amino acid
XPPAASSCLGLPRSWRLRLAYLRAVPSWDLLLPSPTSERLTRSVESWGTQCRRCMRWCPTSRSIAVCTDGKLFNHLETIWRFSPGIPAYPRTCTVDFSISFEFRSLLHSQLATMFFDEVVKQNVAAFERRAATKFGPETAIPRELMFHEVHQT

SEQ ID NO: 18036 - protein, 64 aa, Homo sapiens
  Payload ID: 3616
  Gene Symbol: COQ10A
  Gene Name: coenzyme Q10A
  ENSP ID: ENSP00000447964
  MOD_RES (1)..(1): Any amino acid
XRTCTVDFSISFEFRSLLHSQLATMFFDEVVKQNVAAFERRAATKFGPETAIPRELMFHEVHQT

SEQ ID NO: 18037 - protein, 238 aa, Homo sapiens
  Payload ID: 3617
  Gene Symbol: COQ10B
  Gene Name: coenzyme Q10B
  Uniprot ID: Q9H8M1
  ENSP ID: ENSP00000263960
MAARTGHTALRRVVSGCRPKSATAAGAQAPVRNGRYLASCGILMSRTLPLHTSILPKEICARTFFKITAPLINKRKEYSERRILGYSMQEMYDVVSGVEDYKHFVPWCKKSDVISKRSGYCKTRLEIGFPPVLERYTSVVTLVKPHLVKASCTDGRLFNHLETIWRFSPGLPGYPRTCTLDFSISFEFRSLLHSQLATLFFDEVVKQMVAAFERRACKLYGPETNIPRELMLHEVHHT

SEQ ID NO: 18038 - protein, 188 aa, Homo sapiens
  Payload ID: 3617
  Gene Symbol: COQ10B
  Gene Name: coenzyme Q10B
  ENSP ID: ENSP00000386785
MAARTGHTALRRVVSGCRPKSATAAGAQAPVRNGRYSMQEMYDVVSGVEDYKHFVPWCKKSDVISKRSGYCKTRLEIGFPPVLERYTSVVTLVKPHLVKASCTDGRLFNHLETIWRFSPGLPGYPRTCTLDFSISFEFRSLLHSQLATLFFDEVVKQMVAAFERRACKLYGPETNIPRELMLHEVHHT

SEQ ID NO: 18039 - protein, 210 aa, Homo sapiens
  Payload ID: 3617
  Gene Symbol: COQ10B
  Gene Name: coenzyme Q10B
  ENSP ID: ENSP00000387223
MGVCVWRYLASCGILMSRTLPLHTSILPKEICARTFFKITAPLINKRKEYSERRILGYSMQEMYDVVSGVEDYKHFVPWCKKSDVISKRSGYCKTRLEIGFPPVLERYTSVVTLVKPHLVKASCTDGRLFNHLETIWRFSPGLPGYPRTCTLDFSISFEFRSLLHSQLATLFFDEVVKQMVAAFERRACKLYGPETNIPRELMLHEVHHT

SEQ ID NO: 18040 - protein, 421 aa, Homo sapiens
  Payload ID: 3618
  Gene Symbol: COQ2
  Gene Name: coenzyme Q2 4-hydroxybenzoate polyprenyltransferase
  Uniprot ID: Q96H96
  ENSP ID: ENSP00000310873
MTPISQVRMRKGSAHTAAQPGRLGLHPAGATAHACRGMTSIRARPGLTSAMLGSRAAGFARGLRAVALAWLPGWRGRSFALARAAGAPHGGDLQPPACPEPRGRQLSLSAAAVVDSAPRPLQPYLRLMRLDKPIGTWLLYLPCTWSIGLAAEPGCFPDWYMLSLFGTGAILMRGAGCTINDMWDQDYDKKVTRTANRPIAAGDISTFQSFVFLGGQLTLALGVLLCLNYYSIALGAGSLLLVITYPLMKRISYWPQLALGLTFNWGALLGWSAIKGSCDPSVCLPLYFSGVMWTLIYDTIYAHQDKRDDVLIGLKSTALRFGENTKPWLSGFSVAMLGALSLVGVNSGQTAPYYAALGAVGAHLTHQIYTLDIHRPEDCWNKFISNRTLGLIVFLGIVLGNLWKEKKTDKTKKGIENKIEN

SEQ ID NO: 18041 - protein, 328 aa, Homo sapiens
  Payload ID: 3618
  Gene Symbol: COQ2
  Gene Name: coenzyme Q2 4-hydroxybenzoate polyprenyltransferase
  ENSP ID: ENSP00000311835
MLGSRAAGFARGLRAVALAWLPGWRGRSFALARAAGAPHGGDLQPPACPEPRGRQLSLSAAAVVDSAPRPLQPYLRLMRLDKPIGTWLLYLPCTWSIGLAAEPGCFPDWYMLSLFGTGAILMRGAGCTINDMWDQDYDKKVTRTANRPIAAGDISTFQSFVFLGGQLTLALGVLLCLNYYSIALGAGSLLLVITYPLMKRISYWPQLALGLTFNWGALLGWSAIKGSCDPSVCLPLYFSGVMWTLIYDTIYAHQDKRDDVLIGLKSTALRFGENTKPWLSGFSVAMLGALSLVGVNSGQTAPYYAALGAVGAHLTHQKWGLEILPRLV

SEQ ID NO: 18042 - protein, 213 aa, Homo sapiens
  Payload ID: 3618
  Gene Symbol: COQ2
  Gene Name: coenzyme Q2 4-hydroxybenzoate polyprenyltransferase
  ENSP ID: ENSP00000426242
MLGSRAAGFARGLRAVALAWLPGWRGRSFALARAAGAPHGGDLQPPACPEPRGRQLSLSAAAVVDSAPRPLQPYLRLMRLDKPIGTWLLYLPCTWSIGLAAEPGCFPDWYMLSLFGTGAILMRGAGCTINDMWDQDYDKKVTRTANRPIAAGDISTFQSFVFLGGQLTLALGVLLCLNYYSIALGAGSLLLVITYPLMKRISYWPQLALGQKR

SEQ ID NO: 18043 - protein, 225 aa, Homo sapiens
  Payload ID: 3618
  Gene Symbol: COQ2
  Gene Name: coenzyme Q2 4-hydroxybenzoate polyprenyltransferase
  ENSP ID: ENSP00000427146
GCFPDWYMLSLFGTGAILMRGAGCTINDMWDQDYDKKVTRTANRPIAAGDISTFQSFVFLGGQLTLALGVLLCLNYYSIALGAGSLLLVITYPLMKRISYWPQLALGLTFNWGALLGWSAIKGSCDPSVCLPLYFSGVMWTLIYDTIYAHQDKRDDVLIGLKSTALRFGENTKPWLSGFSVAMLGALSLVGVNSGQTAPYYAALGAVGAHLTHQKWGLEILPRLV

SEQ ID NO: 18044 - protein, 369 aa, Homo sapiens
  Payload ID: 3619
  Gene Symbol: COQ3
  Gene Name: coenzyme Q3 methyltransferase
  Uniprot ID: Q9NZJ6
  ENSP ID: ENSP00000254759
MWSGRKLGSSGGWFLRVLGPGGCNTKAARPLISSAVYVKNQLSGTLQIKPGVFNEYRTIWFKSYRTIFSCLNRIKSFRYPWARLYSTSQTTVDSGEVKTFLALAHKWWDEQGVYAPLHSMNDLRVPFIRDNLLKTIPNHQPGKPLLGMKILDVGCGGGLLTEPLGRLGASVIGIDPVDENIKTAQCHKSFDPVLDKRIEYRVCSLEEIVEETAETFDAVVASEVVEHVIDLETFLQCCCQVLKPGGSLFITTINKTQLSYALGIVFSEQIASIVPKGTHTWEKFVSPETLESILESNGLSVQTVVGMLYNPFSGYWHWSENTSLNYAAYAVKSRVQEHPASAEFVLKGETEELQANACTNPAVHEKLKK

SEQ ID NO: 18045 - protein, 141 aa, Homo sapiens
  Payload ID: 3619
  Gene Symbol: COQ3
  Gene Name: coenzyme Q3 methyltransferase
  ENSP ID: ENSP00000358243
MKILDVGCGGGLLTEPGGSLFITTINKTQLSYALGIVFSEQIASIVPKGTHTWEKFVSPETLESILESNGLSVQTVVGMLYNPFSGYWHWSENTSLNYAAYAVKSRVQEHPASAEFVLKGETEELQANACTNPAVHEKLKK

SEQ ID NO: 18046 - protein, 310 aa, Homo sapiens
  Payload ID: 3619
  Gene Symbol: COQ3
  Gene Name: coenzyme Q3 methyltransferase
  ENSP ID: ENSP00000358245
MFKSYRTIFSCLNRIKSFRYPWARLYSTSQTTVDSGEVKTFLALAHKWWDEQGVYAPLHSMNDLRVPFIRDNLLKTIPNHQPGKPLLGMKILDVGCGGGLLTEPLGRLGASVIGIDPVDENIKTAQCHKSFDPVLDKRIEYRVCSLEEIVEETAETFDAVVASEVVEHVIDLETFLQCCCQVLKPGGSLFITTINKTQLSYALGIVFSEQIASIVPKGTHTWEKFVSPETLESILESNGLSVQTVVGMLYNPFSGYWHWSENTSLNYAAYAVKSRVQEHPASAEFVLKGETEELQANACTNPAVHEKLKK

SEQ ID NO: 18047 - protein, 265 aa, Homo sapiens
  Payload ID: 3620
  Gene Symbol: COQ4
  Gene Name: coenzyme Q4
  Uniprot ID: Q9Y3A0
  ENSP ID: ENSP00000300452
MATLLRPVLRRLCGLPGLQRPAAEMPLRARSDGAGPLYSHHLPTSPLQKGLLAAGSAAMALYNPYRHDMVAVLGETTGHRTLKVLRDQMRRDPEGAQILQERPRISTSTLDLGKLQSLPEGSLGREYLRFLDVNRVSPDTRAPTRFVDDEELAYVIQRYREVHDMLHTLLGMPTNILGEIVVKWFEAVQTGLPMCILGAFFGPIRLGAQSLQVLVSELIPWAVQNGRRAPCVLNLYYERRWEQSLRALREELGITAPPMHVQGLA

SEQ ID NO: 18048 - protein, 151 aa, Homo sapiens
  Payload ID: 3620
  Gene Symbol: COQ4
  Gene Name: coenzyme Q4
  ENSP ID: ENSP00000361966
MATLLRPVLRRLCGLPGLQRPAAEMPLRARSDGAGPLYSHHLPTSPLQKGLLAAGSAAMALYNPYRHDMVAVLGETTGHRTLKVLRDQMRRDPEGAQILQERPRISTSTLDLGKLQSLPEGSLGREYLRFLDVNVSFQLLCIWQSPDRTEE

SEQ ID NO: 18049 - protein, 96 aa, Homo sapiens
  Payload ID: 3620
  Gene Symbol: COQ4
  Gene Name: coenzyme Q4
  ENSP ID: ENSP00000476323
MATLLRPVLRRLCGLPGLQRPAAEMPLRARSDGAGPLYSHHLPTSPLQKGLLAAGSAAMALYNPYRHDSWIPPKRTESESESAVEGEMGVKPKVCL

SEQ ID NO: 18050 - protein, 86 aa, Homo sapiens
  Payload ID: 3620
  Gene Symbol: COQ4
  Gene Name: coenzyme Q4
  ENSP ID: ENSP00000477292
MATLLRPVLRRLCGLPGLQRPAAEMPLRARSDGAGPLYSHHLPTSPLQKGLLAAGSAAMALYNPYRHGKAARASPPWGRLGAVSCG

SEQ ID NO: 18051 - protein, 327 aa, Homo sapiens
  Payload ID: 3621
  Gene Symbol: COQ5
  Gene Name: coenzyme Q5, methyltransferase
  Uniprot ID: Q5HYK3
  ENSP ID: ENSP00000288532
MAAPGSCALWSYCGRGWSRAMRGCQLLGLRSSWPGDLLSARLLSQEKRAAETHFGFETVSEEEKGGKVYQVFESVAKKYDVMNDMMSLGIHRVWKDLLLWKMHPLPGTQLLDVAGGTGDIAFRFLNYVQSQHQRKQKRQLRAQQNLSWEEIAKEYQNEEDSLGGSRVVVCDINKEMLKVGKQKALAQGYRAGLAWVLGDAEELPFDDDKFDIYTIAFGIRNVTHIDQALQEAHRVLKPGGRFLCLEFSQVNNPLISRLYDLYSFQVIPVLGEVIAGDWKSYQYLVESIRRFPSQEEFKDMIEDAGFHKVTYESLTSGIVAIHSGFKL

SEQ ID NO: 18052 - protein, 253 aa, Homo sapiens
  Payload ID: 3621
  Gene Symbol: COQ5
  Gene Name: coenzyme Q5, methyltransferase
  ENSP ID: ENSP00000401798
MAAPGSCALWSYCGRGWSRAMRGCQLLGLRSSWPGDLLSARLLSQEKRAAETHFGFETVSEEEKGGKVYQVFESVAKKYDVMNDMMSLGIHRVWKDLLLWKMHPLPGTQLLDVAGGTGLAWVLGDAEELPFDDDKFDIYTIAFGIRNVTHIDQALQEAHRVLKPGGRFLCLEFSQVNNPLISRLYDLYSFQVIPVLGEVIAGDWKSYQYLVESIRRFPSQEEFKDMIEDAGFHKVTYESLTSGIVAIHSGFKL

SEQ ID NO: 18053 - protein, 213 aa, Homo sapiens
  Payload ID: 3621
  Gene Symbol: COQ5
  Gene Name: coenzyme Q5, methyltransferase
  ENSP ID: ENSP00000449863
MNDMMSLGIHRVWKDLLLWKMHPLPGTQLLDVAGGTGDIAFRFLNYVQSQHQRKQKRQLRAQQNLSWEEIAKEYQNEEDSLGGSRVVVCDINKEMLKVGKQKALAQGYRAGLAWVLGDAEELPFDDDKFDIYTIAFGIRNVTHIDQALQEAHRVLKPGGRFLCLEFSQVNNPLISRLYDLYSFQVIPVLGEVIAGDWKSYQYLVESIRRFPSQ

SEQ ID NO: 18054 - protein, 176 aa, Homo sapiens
  Payload ID: 3621
  Gene Symbol: COQ5
  Gene Name: coenzyme Q5, methyltransferase
  ENSP ID: ENSP00000449874
MAAPGSCALWSYCGRGWSRAMRGCQLLGLRSSWPGDLLSARLLSQEKRAAETHFGFETVSEEEKGGKGDIAFRFLNYVQSQHQRKQKRQLRAQQNLSWEEIAKEYQNEEDSLGGSRVVVCDINKEMLKVGKQKALAQGYRAGLAWVLGDAEELPFDDDKFDIYTIAFGIRNVTHID

SEQ ID NO: 18055 - protein, 91 aa, Homo sapiens
  Payload ID: 3621
  Gene Symbol: COQ5
  Gene Name: coenzyme Q5, methyltransferase
  ENSP ID: ENSP00000449933
MLSLSLSPRLECSGPISAHCNLYLPGSSDSPAPTTRVAGITVYQVFESVAKKYDVMNDMMSLGIHRVWKDLLLWKMHPLPGTQLLDVAGGT

SEQ ID NO: 18056 - protein, 130 aa, Homo sapiens
  Payload ID: 3621
  Gene Symbol: COQ5
  Gene Name: coenzyme Q5, methyltransferase
  ENSP ID: ENSP00000450001
MNDMMSLGIHRVWKDLLLWKMHPLPGTQLLDVAGGTGDIAFRFLNYVQSQHQRKQKRQLRAQQNLSWEEIAKEYQNEEDSLGGSRVVVCDINKEMLKVGKQKALAQGYRAGLAWVLGDAEELPFDDDKFD

SEQ ID NO: 18057 - protein, 467 aa, Homo sapiens
  Payload ID: 3622
  Gene Symbol: COQ6
  Gene Name: coenzyme Q6 monooxygenase
  ENSP ID: ENSP00000238709
MAARLVSRCGAVRAAPHSGPLVLAQVVRRSTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 18058 - protein, 468 aa, Homo sapiens
  Payload ID: 3622
  Gene Symbol: COQ6
  Gene Name: coenzyme Q6 monooxygenase
  Uniprot ID: Q9Y2Z9
  ENSP ID: ENSP00000333946
MAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 18059 - protein, 443 aa, Homo sapiens
  Payload ID: 3622
  Gene Symbol: COQ6
  Gene Name: coenzyme Q6 monooxygenase
  Uniprot ID: Q9Y2Z9
  ENSP ID: ENSP00000377594
MRGQGPPLSSFGVWLASRAASDPSRPRRQGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 18060 - protein, 111 aa, Homo sapiens
  Payload ID: 3622
  Gene Symbol: COQ6
  Gene Name: coenzyme Q6 monooxygenase
  ENSP ID: ENSP00000450511
MAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSVGRLLRGPDNV

SEQ ID NO: 18061 - protein, 86 aa, Homo sapiens
  Payload ID: 3622
  Gene Symbol: COQ6
  Gene Name: coenzyme Q6 monooxygenase
  ENSP ID: ENSP00000450736
MRGQGPPLSSFGVWLASRAASDPSRPRRQGYDIHFHDKKILLLEAGPKKVLEKLSETYSNRVSSISPGSATLLSSVGRLLRGPDNV

SEQ ID NO: 18062 - protein, 262 aa, Homo sapiens
  Payload ID: 3622
  Gene Symbol: COQ6
  Gene Name: coenzyme Q6 monooxygenase
  ENSP ID: ENSP00000451123
MIFTFMTRKSCCSKQVQRKYWRNCQKLTATGSAPFPLALQRFSVVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVAR

SEQ ID NO: 18063 - protein, 54 aa, Homo sapiens
  Payload ID: 3622
  Gene Symbol: COQ6
  Gene Name: coenzyme Q6 monooxygenase
  ENSP ID: ENSP00000451301
MIFTFMTRKSCCSKQVQRKYWRNCQKLTATGSAPFPLALQRFSVVLVPGTISAT

SEQ ID NO: 18064 - protein, 200 aa, Homo sapiens
  Payload ID: 3622
  Gene Symbol: COQ6
  Gene Name: coenzyme Q6 monooxygenase
  ENSP ID: ENSP00000451562
MAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSGTDYGLCKQMSTPLLKKDYVDEKEHPAQDPSYIFSRSYLI

SEQ ID NO: 18065 - protein, 111 aa, Homo sapiens; identical to SEQ ID NO: 18060
  Payload ID: 3622
  Gene Symbol: COQ6
  Gene Name: coenzyme Q6 monooxygenase
  ENSP ID: ENSP00000451685

SEQ ID NO: 18066 - protein, 393 aa, Homo sapiens
  Payload ID: 3622
  Gene Symbol: COQ6
  Gene Name: coenzyme Q6 monooxygenase
  ENSP ID: ENSP00000486650
MIFTFMTRKSCCSKQVQRKYWRNCQKLTATGSAPFPLALQRFSVVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 18067 - protein, 217 aa, Homo sapiens
  Payload ID: 3623
  Gene Symbol: COQ7
  Gene Name: coenzyme Q7 homolog, ubiquinone (yeast)
  Uniprot ID: Q99807
  ENSP ID: ENSP00000322316
MSCAGAAAAPRLWRLRPGARRSLSAYGRRTSVRFRSSGMTLDNISRAAVDRIIRVDHAGEYGANRIYAGQMAVLGRTSVGPVIQKMWDQEKDHLKKFNELMVTFRVRPTVLMPLWNVLGFALGAGTALLGKEGAMACTVAVEESIAHHYNNQIRTLMEEDPEKYEELLQLIKKFRDEELEHHDIGLDHDAELAPAYAVLKSIIQAGCRVAIYLSERL

SEQ ID NO: 18068 - protein, 179 aa, Homo sapiens
  Payload ID: 3623
  Gene Symbol: COQ7
  Gene Name: coenzyme Q7 homolog, ubiquinone (yeast)
  Uniprot ID: Q99807
  ENSP ID: ENSP00000442923
MTLDNISRAAVDRIIRVDHAGEYGANRIYAGQMAVLGRTSVGPVIQKMWDQEKDHLKKFNELMVTFRVRPTVLMPLWNVLGFALGAGTALLGKEGAMACTVAVEESIAHHYNNQIRTLMEEDPEKYEELLQLIKKFRDEELEHHDIGLDHDAELAPAYAVLKSIIQAGCRVAIYLSERL

SEQ ID NO: 18069 - protein, 194 aa, Homo sapiens
  Payload ID: 3623
  Gene Symbol: COQ7
  Gene Name: coenzyme Q7 homolog, ubiquinone (yeast)
  ENSP ID: ENSP00000455122
MAYGRRTSVRFRSSGMTLDNISRAAVDRIIRVDHAGEYGANRIYAGQMAVLGRTSVGPVIQKMWDQEKDHLKKFNELMVTFRVRPTVLMPLWNVLGFALGAGTALLGKEGAMACTVAVEESIAHHYNNQIRTLMEEDPEKYEELLQLIKKFRDEELEHHDIGLDHDAELAPAYAVLKSIIQAGCRVAIYLSERL

SEQ ID NO: 18070 - protein, 106 aa, Homo sapiens
  Payload ID: 3623
  Gene Symbol: COQ7
  Gene Name: coenzyme Q7 homolog, ubiquinone (yeast)
  ENSP ID: ENSP00000456490
MSCAGAAAAPRLWRLRPGARRSLSAYGRRTSVRFRSSGMTLDNISRAAVDRIIRVDHAGEYGANRIYAGQMAVLGRTSVGPVIQGRGPPCSGRKVPWPAPWRWKRA

SEQ ID NO: 18071 - protein, 217 aa, Homo sapiens; identical to SEQ ID NO: 18067
  Payload ID: 3623
  Gene Symbol: COQ7
  Gene Name: coenzyme Q7 homolog, ubiquinone (yeast)
  Uniprot ID: Q99807
  ENSP ID: ENSP00000456734

SEQ ID NO: 18072 - protein, 103 aa, Homo sapiens
  Payload ID: 3623
  Gene Symbol: COQ7
  Gene Name: coenzyme Q7 homolog, ubiquinone (yeast)
  ENSP ID: ENSP00000456943
MTLDNISRAAVDRIIRVDHAGEYGANRIYAGQMAVLGRTSVGPVIQKMWDQEKDHLKKFNELMVTFRVRPTVLMPLWNVLGFALGAGTALLGKEGAMACTVAV

SEQ ID NO: 18073 - protein, 130 aa, Homo sapiens
  Payload ID: 3623
  Gene Symbol: COQ7
  Gene Name: coenzyme Q7 homolog, ubiquinone (yeast)
  ENSP ID: ENSP00000457256
MTLDNISRAAVDRIIRVDHAGEYGANRIYAGQMAVLGRTSVGPVIQKMWDQEKDHLKKFNELMVTFRVRPTVLMPLWNVLGFALGAGTALLGKEGAMACTVAVEESIAHHYNNQIRTLMEEDPEKYEELL

SEQ ID NO: 18074 - protein, 136 aa, Homo sapiens
  Payload ID: 3623
  Gene Symbol: COQ7
  Gene Name: coenzyme Q7 homolog, ubiquinone (yeast)
  ENSP ID: ENSP00000459076
MSCAGAAAAPRLWRLRPGARRSLSAYGRRTSVRFRSSGMTLDNISRAAVDRIIRVDHAGEYGANRIYAGQMAVLGRTSVGPVIQKMWDQEKDHLKKFNELMVTFRVRPTVLMPLWNVLGFALGTCLSRRAYASLGI

SEQ ID NO: 18075 - protein, 318 aa, Homo sapiens
  Payload ID: 3624
  Gene Symbol: COQ9
  Gene Name: coenzyme Q9
  Uniprot ID: O75208
  ENSP ID: ENSP00000262507
MAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLVQLGQAEKRKTDQFLRDAVETRLRMLIPYIEHWPRALSILMLPHNIPSSLSLLTSMVDDMWHYAGDQSTDFNWYTRRAMLAAIYNTTELVMMQDSSPDFEDTWRFLENRVNDAMNMGHTAKQVKSTGEALVQGLMGAAVTLKNLTGLNQRR

SEQ ID NO: 18076 - protein, 303 aa, Homo sapiens
  Payload ID: 3624
  Gene Symbol: COQ9
  Gene Name: coenzyme Q9
  ENSP ID: ENSP00000454992
MAAAAVSGALGRAGWRLLQLRCLPVSVSVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLVQLGQAEKRKTDQFLRDAVETRLRMLIPYIEHWPRALSILMLPHNIPSSLSLLTSMVDDMWHYAGDQSTDFNWYTRRAMLAAIYNTTELVMMQDSSPDFEDTWRFLENRVNDAMNMGHTAKQVKSTGEALVQ

SEQ ID NO: 18077 - protein, 188 aa, Homo sapiens
  Payload ID: 3624
  Gene Symbol: COQ9
  Gene Name: coenzyme Q9
  ENSP ID: ENSP00000455256
MAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLVQLGQAEPSASSCSLTTSRPA

SEQ ID NO: 18078 - protein, 102 aa, Homo sapiens
  Payload ID: 3624
  Gene Symbol: COQ9
  Gene Name: coenzyme Q9
  ENSP ID: ENSP00000455495
QLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEV

SEQ ID NO: 18079 - protein, 89 aa, Homo sapiens
  Payload ID: 3624
  Gene Symbol: COQ9
  Gene Name: coenzyme Q9
  ENSP ID: ENSP00000455516
MFGKDGSELILHFVTQCNTRLTRVLEEEQKLVQLGQAEKRKTDQFLRDAVETRLRMLIPYIEHWPRALSILMLPHNIPSSLSLLTSMVD

SEQ ID NO: 18080 - protein, 207 aa, Homo sapiens
  Payload ID: 3624
  Gene Symbol: COQ9
  Gene Name: coenzyme Q9
  ENSP ID: ENSP00000456174
MAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQFNWYTRRAMLAAIYNTTELVMMQDSSPDFEDTWRFLENRVNDAMNMGHTAKQVKSTGEALVQGLMGAAVTLKNLTGLNQRR

SEQ ID NO: 18081 - protein, 283 aa, Homo sapiens
  Payload ID: 3624
  Gene Symbol: COQ9
  Gene Name: coenzyme Q9
  ENSP ID: ENSP00000456728
MAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLALSILMLPHNIPSSLSLLTSMVDDMWHYAGDQSTDFNWYTRRAMLAAIYNTTELVMMQDSSPDFEDTWRFLENRVNDAMNMGHTAKQVKSTGEALVQGLMGAAVTLKNLTGLNQRR

SEQ ID NO: 18082 - protein, 172 aa, Homo sapiens
  Payload ID: 3624
  Gene Symbol: COQ9
  Gene Name: coenzyme Q9
  ENSP ID: ENSP00000458023
MAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQALSILMLPHNIPSSLSLLTSMVDDMWHYAGDQSTDFNWYTRRAMLA

SEQ ID NO: 18083 - protein, 166 aa, Homo sapiens
  Payload ID: 3625
  Gene Symbol: CFL1
  Gene Name: cofilin 1 (non-muscle)
  Uniprot ID: P23528
  ENSP ID: ENSP00000309629
MASGVAVSDGVIKVFNDMKVRKSSTPEEVKKRKKAVLFCLSEDKKNIILEEGKEILVGDVGQTVDDPYATFVKMLPDKDCRYALYDATYETKESKKEDLVFIFWAPESAPLKSKMIYASSKDAIKKKLTGIKHELQANCYEEVKDRCTLAEKLGGSAVISLEGKPL

SEQ ID NO: 18084 - protein, 204 aa, Homo sapiens
  Payload ID: 3625
  Gene Symbol: CFL1
  Gene Name: cofilin 1 (non-muscle)
  ENSP ID: ENSP00000431696
MVSPGHGHLRERKELTPHSTNPAAARIWDATYSDGYVRPASGVAVSDGVIKVFNDMKVRKSSTPEEVKKRKKAVLFCLSEDKKNIILEEGKEILVGDVGQTVDDPYATFVKMLPDKDCRYALYDATYETKESKKEDLVFIFWAPESAPLKSKMIYASSKDAIKKKLTGIKHELQANCYEEVKDRCTLAEKLGGSAVISLEGKPL

SEQ ID NO: 18085 - protein, 90 aa, Homo sapiens
  Payload ID: 3625
  Gene Symbol: CFL1
  Gene Name: cofilin 1 (non-muscle)
  ENSP ID: ENSP00000432153
MASGVAVSDGVIKVFNDMKVRKSSTPEEVKKRKKAVLFCLSEDKKNIILEEGKEILVGDVGQTVDDPYATFVKMLPDKDCRYALYDATYE

SEQ ID NO: 18086 - protein, 149 aa, Homo sapiens
  Payload ID: 3625
  Gene Symbol: CFL1
  Gene Name: cofilin 1 (non-muscle)
  ENSP ID: ENSP00000432155
MKVRKSSTPEEVKKRKKAVLFCLSEDKKNIILEEGKEILVGDVGQTVDDPYATFVKMLPDKDCRYALYDATYETKESKKEDLVFIFWAPESAPLKSKMIYASSKDAIKKKLTGIKHELQANCYEEVKDRCTLAEKLGGSAVISLEGKPL

SEQ ID NO: 18087 - protein, 149 aa, Homo sapiens; identical to SEQ ID NO: 18086
  Payload ID: 3625
  Gene Symbol: CFL1
  Gene Name: cofilin 1 (non-muscle)
  ENSP ID: ENSP00000432226

SEQ ID NO: 18088 - protein, 166 aa, Homo sapiens; identical to SEQ ID NO: 18083
  Payload ID: 3625
  Gene Symbol: CFL1
  Gene Name: cofilin 1 (non-muscle)
  Uniprot ID: P23528
  ENSP ID: ENSP00000432660

SEQ ID NO: 18089 - protein, 149 aa, Homo sapiens; identical to SEQ ID NO: 18086
  Payload ID: 3625
  Gene Symbol: CFL1
  Gene Name: cofilin 1 (non-muscle)
  ENSP ID: ENSP00000433131

SEQ ID NO: 18090 - protein, 79 aa, Homo sapiens
  Payload ID: 3625
  Gene Symbol: CFL1
  Gene Name: cofilin 1 (non-muscle)
  ENSP ID: ENSP00000433308
MKVRKSSTPEEVKKRKKAVLFCLSEDKKNIILEEGKEILVGDVGQTVDDPYATFVKMLPDKDCRYALYDATYETKESKK

SEQ ID NO: 18091 - protein, 149 aa, Homo sapiens; identical to SEQ ID NO: 18086
  Payload ID: 3625
  Gene Symbol: CFL1
  Gene Name: cofilin 1 (non-muscle)
  ENSP ID: ENSP00000433910

SEQ ID NO: 18092 - protein, 159 aa, Homo sapiens
  Payload ID: 3625
  Gene Symbol: CFL1
  Gene Name: cofilin 1 (non-muscle)
  ENSP ID: ENSP00000436431
MASGVAVSDGVIKVFNDMKVRKSSTPEEVKKRKKAVLFCLSEDKKNIILEEGKEILVGDVGQTVDDPYATFVKMLPDKDCRYALYDATYETKESKKEDLVFIFWAPESAPLKSKMIYASSKDAIKKKLTGIKHELQANCYEEVKDRCTLAEKLGGSAVI

SEQ ID NO: 18093 - protein, 122 aa, Homo sapiens
  Payload ID: 3625
  Gene Symbol: CFL1
  Gene Name: cofilin 1 (non-muscle)
  ENSP ID: ENSP00000436899
MKVRKSSTPEEVKKRKKAVLFCLSEDKKNIILEEGKEILVGDVGQTVDDPYATFVKMLPDKDCRYALYDATYETKESKKEDLVFIFWAPESAPLKSKMIYASSKDAIKKKLTGIKHELQANC

SEQ ID NO: 18094 - protein, 166 aa, Homo sapiens
  Payload ID: 3626
  Gene Symbol: CFL2
  Gene Name: cofilin 2 (muscle)
  Uniprot ID: Q9Y281
  ENSP ID: ENSP00000298159
MASGVTVNDEVIKVFNDMKVRKSSTQEEIKKRKKAVLFCLSDDKRQIIVEEAKQILVGDIGDTVEDPYTSFVKLLPLNDCRYALYDATYETKESKKEDLVFIFWAPESAPLKSKMIYASSKDAIKKKFTGIKHEWQVNGLDDIKDRSTLGEKLGGNVVVSLEGKPL

SEQ ID NO: 18095 - protein, 166 aa, Homo sapiens; identical to SEQ ID NO: 18094
  Payload ID: 3626
  Gene Symbol: CFL2
  Gene Name: cofilin 2 (muscle)
  Uniprot ID: Q9Y281
  ENSP ID: ENSP00000340635

SEQ ID NO: 18096 - protein, 58 aa, Homo sapiens
  Payload ID: 3626
  Gene Symbol: CFL2
  Gene Name: cofilin 2 (muscle)
  ENSP ID: ENSP00000409326
MASGVTVNDEVIKVFNDMKVRKSSTQEEIKKRKKAVLFCLSDDKRQIIVEEAKQILGS

SEQ ID NO: 18097 - protein, 21 aa, Homo sapiens
  Payload ID: 3626
  Gene Symbol: CFL2
  Gene Name: cofilin 2 (muscle)
  ENSP ID: ENSP00000450862
MASGVTVNDEVIKVFNDMKGS

SEQ ID NO: 18098 - protein, 149 aa, Homo sapiens
  Payload ID: 3626
  Gene Symbol: CFL2
  Gene Name: cofilin 2 (muscle)
  Uniprot ID: Q9Y281
  ENSP ID: ENSP00000452188
MKVRKSSTQEEIKKRKKAVLFCLSDDKRQIIVEEAKQILVGDIGDTVEDPYTSFVKLLPLNDCRYALYDATYETKESKKEDLVFIFWAPESAPLKSKMIYASSKDAIKKKFTGIKHEWQVNGLDDIKDRSTLGEKLGGNVVVSLEGKPL

SEQ ID NO: 18099 - protein, 149 aa, Homo sapiens; identical to SEQ ID NO: 18098
  Payload ID: 3626
  Gene Symbol: CFL2
  Gene Name: cofilin 2 (muscle)
  Uniprot ID: Q9Y281
  ENSP ID: ENSP00000452451

SEQ ID NO: 18100 - protein, 782 aa, Homo sapiens
  Payload ID: 3627
  Gene Symbol: CCHCR1
  Gene Name: coiled-coil alpha-helical rod protein 1
  Uniprot ID: Q8TD31
  ENSP ID: ENSP00000365442
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 18101 - protein, 782 aa, Homo sapiens
  Payload ID: 3627
  Gene Symbol: CCHCR1
  Gene Name: coiled-coil alpha-helical rod protein 1
  Uniprot ID: Q8TD31
  ENSP ID: ENSP00000372832
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRWLEEEVWLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRWWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQCQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSCNPQMSS

SEQ ID NO: 18102 - protein, 782 aa, Homo sapiens; identical to SEQ ID NO: 18100
  Payload ID: 3627
  Gene Symbol: CCHCR1
  Gene Name: coiled-coil alpha-helical rod protein 1
  Uniprot ID: Q8TD31
  ENSP ID: ENSP00000373019

SEQ ID NO: 18103 - protein, 729 aa, Homo sapiens
  Payload ID: 3627
  Gene Symbol: CCHCR1
  Gene Name: coiled-coil alpha-helical rod protein 1
  ENSP ID: ENSP00000379561
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 18104 - protein, 871 aa, Homo sapiens
  Payload ID: 3627
  Gene Symbol: CCHCR1
  Gene Name: coiled-coil alpha-helical rod protein 1
  Uniprot ID: Q8TD31
  ENSP ID: ENSP00000379566
MWPHSAGARPWASTLTGKDPRVMACWCLDGLPSGLAEPWRELWRWRSRPLHCVPPFSPLARSSRDHRNLRRRGNIDGWRQNLEPSNNVEMFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 18105 - protein, 729 aa, Homo sapiens
  Payload ID: 3627
  Gene Symbol: CCHCR1
  Gene Name: coiled-coil alpha-helical rod protein 1
  ENSP ID: ENSP00000383204
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRWLEEEVWLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRWWQQQTASAEEQLRLVVNAVSSCPLPPPVTDVSLELQQLREERNRLDAELQLSARLIQQEVGRAREQGEAERQQLSKVAQQLEQELQQTQESLASLGLQLEVARQCQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSCNPQMSS

SEQ ID NO: 18106 - protein, 782 aa, Homo sapiens; identical to SEQ ID NO: 18101
  Payload ID: 3627
  Gene Symbol: CCHCR1
  Gene Name: coiled-coil alpha-helical rod protein 1
  Uniprot ID: Q8TD31
  ENSP ID: ENSP00000383205

SEQ ID NO: 18107 - protein, 729 aa, Homo sapiens; identical to SEQ ID NO: 18103
  Payload ID: 3627
  Gene Symbol: CCHCR1
  Gene Name: coiled-coil alpha-helical rod protein 1
  ENSP ID: ENSP00000383257

SEQ ID NO: 18108 - protein, 871 aa, Homo sapiens; identical to SEQ ID NO: 18104
  Payload ID: 3627
  Gene Symbol: CCHCR1
  Gene Name: coiled-coil alpha-helical rod protein 1
  Uniprot ID: Q8TD31
  ENSP ID: ENSP00000383263

SEQ ID NO: 18109 - protein, 118 aa, Homo sapiens
  Payload ID: 3627
  Gene Symbol: CCHCR1
  Gene Name: coiled-coil alpha-helical rod protein 1
  ENSP ID: ENSP00000388264
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQ

SEQ ID NO: 18110 - protein, 188 aa, Homo sapiens
  Payload ID: 3627
  Gene Symbol: CCHCR1
  Gene Name: coiled-coil alpha-helical rod protein 1
  ENSP ID: ENSP00000388748
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEE

SEQ ID NO: 18111 - protein, 171 aa, Homo sapiens
  Payload ID: 3627
  Gene Symbol: CCHCR1
  Gene Name: coiled-coil alpha-helical rod protein 1
  ENSP ID: ENSP00000389131
MFPPSGQWDQTRGVVVVSAWETDHLCFCNSSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEG

SEQ ID NO: 18112 - protein, 126 aa, Homo sapiens
  Payload ID: 3627
  Gene Symbol: CCHCR1
  Gene Name: coiled-coil alpha-helical rod protein 1
  ENSP ID: ENSP00000389303
MFPPSGQWDQTRGVVVVSAWETDHLCFCNSSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQE

SEQ ID NO: 18113 - protein, 126 aa, Homo sapiens; identical to SEQ ID NO: 18112
  Payload ID: 3627
  Gene Symbol: CCHCR1
  Gene Name: coiled-coil alpha-helical rod protein 1
  ENSP ID: ENSP00000389758

SEQ ID NO: 18114 - protein, 188 aa, Homo sapiens; identical to SEQ ID NO: 18110
  Payload ID: 3627
  Gene Symbol: CCHCR1
  Gene Name: coiled-coil alpha-helical rod protein 1
  ENSP ID: ENSP00000390027

SEQ ID NO: 18115 - protein, 256 aa, Homo sapiens
  Payload ID: 3627
  Gene Symbol: CCHCR1
  Gene Name: coiled-coil alpha-helical rod protein 1
  ENSP ID: ENSP00000390313
  MOD_RES (1)..(1): Any amino acid
XRLDAELQLSARLIQQEVGRAREQGEAERQQLSKVAQQLEQELQQTQESLASLGLQLEVARQCQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLQRLLTVLPSLLDKKKSVVSSPRPPECSASAPVAAAVPTRESIKGSLSVLLDDLQDLSEAISKEEAVCQGDNLDRCSSCNPQMSS

SEQ ID NO: 18116 - protein, 256 aa, Homo sapiens
  Payload ID: 3627
  Gene Symbol: CCHCR1
  Gene Name: coiled-coil alpha-helical rod protein 1
  ENSP ID: ENSP00000390347
  MOD_RES (1)..(1): Any amino acid
XRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 18117 - protein, 256 aa, Homo sapiens; identical to SEQ ID NO: 18115
  Payload ID: 3627
  Gene Symbol: CCHCR1
  Gene Name: coiled-coil alpha-helical rod protein 1
  ENSP ID: ENSP00000390479
  MOD_RES (1)..(1): Any amino acid

SEQ ID NO: 18118 - protein, 316 aa, Homo sapiens
  Payload ID: 3627
  Gene Symbol: CCHCR1
  Gene Name: coiled-coil alpha-helical rod protein 1
  ENSP ID: ENSP00000391018
MFPPSGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLDTMQHLQEDRDSLHATAELLQVRVQSLTHILALQEEELTRKVQPSDSLEPEFTRKCQSLLNRWREKVFALMVQLKAQE

SEQ ID NO: 18119 - protein, 782 aa, Homo sapiens
  Payload ID: 3627
  Gene Symbol: CCHCR1
  Gene Name: coiled-coil alpha-helical rod protein 1
  ENSP ID: ENSP00000391181
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLDTMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 18120 - protein, 216 aa, Homo sapiens
  Payload ID: 3627
  Gene Symbol: CCHCR1
  Gene Name: coiled-coil alpha-helical rod protein 1
  ENSP ID: ENSP00000391707
MWPHSAGARPWASTLTGKDPRVMACWCLDGLPSGLAEPWRELWRWRSRPLHCVPPFSPLARSSRDHRNLRRRVEALPRILKGNIDGWRQNLEPSNNVEMFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQ

SEQ ID NO: 18121 - protein, 782 aa, Homo sapiens; identical to SEQ ID NO: 18101
  Payload ID: 3627
  Gene Symbol: CCHCR1
  Gene Name: coiled-coil alpha-helical rod protein 1
  Uniprot ID: Q8TD31
  ENSP ID: ENSP00000393042

SEQ ID NO: 18122 - protein, 126 aa, Homo sapiens; identical to SEQ ID NO: 18112
  Payload ID: 3627
  Gene Symbol: CCHCR1
  Gene Name: coiled-coil alpha-helical rod protein 1
  ENSP ID: ENSP00000393508

SEQ ID NO: 18123 - protein, 171 aa, Homo sapiens
  Payload ID: 3627
  Gene Symbol: CCHCR1
  Gene Name: coiled-coil alpha-helical rod protein 1
  ENSP ID: ENSP00000394964
MFPPSGQWDQTRGVVVVSAWETDHLCFCNSSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRWLEEEVWLLRETSLQQKMRLEAQAMELEALARAEKAGRAEAEG

SEQ ID NO: 18124 - protein, 316 aa, Homo sapiens; identical to SEQ ID NO: 18118
  Payload ID: 3627
  Gene Symbol: CCHCR1
  Gene Name: coiled-coil alpha-helical rod protein 1
  ENSP ID: ENSP00000395434

SEQ ID NO: 18125 - protein, 118 aa, Homo sapiens
  Payload ID: 3627
  Gene Symbol: CCHCR1
  Gene Name: coiled-coil alpha-helical rod protein 1
  ENSP ID: ENSP00000396155
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRWLEEEVWLLRETSLQQ

SEQ ID NO: 18126 - protein, 188 aa, Homo sapiens
  Payload ID: 3627
  Gene Symbol: CCHCR1
  Gene Name: coiled-coil alpha-helical rod protein 1
  ENSP ID: ENSP00000396200
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRWLEEEVWLLRETSLQQKMRLEAQAMELEALARAEKAGRAEAEGLRAALAGAEVVRKNLEEGRQRELEEVQRLHQEQLSSLTQAHEE

SEQ ID NO: 18127 - protein, 126 aa, Homo sapiens; identical to SEQ ID NO: 18112
  Payload ID: 3627
  Gene Symbol: CCHCR1
  Gene Name: coiled-coil alpha-helical rod protein 1
  ENSP ID: ENSP00000396696

SEQ ID NO: 18128 - protein, 152 aa, Homo sapiens
  Payload ID: 3627
  Gene Symbol: CCHCR1
  Gene Name: coiled-coil alpha-helical rod protein 1
  ENSP ID: ENSP00000397446
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAG

SEQ ID NO: 18129 - protein, 118 aa, Homo sapiens; identical to SEQ ID NO: 18125
  Payload ID: 3627
  Gene Symbol: CCHCR1
  Gene Name: coiled-coil alpha-helical rod protein 1
  ENSP ID: ENSP00000397856

SEQ ID NO: 18130 - protein, 152 aa, Homo sapiens; identical to SEQ ID NO: 18128
  Payload ID: 3627
  Gene Symbol: CCHCR1
  Gene Name: coiled-coil alpha-helical rod protein 1
  ENSP ID: ENSP00000398715

SEQ ID NO: 18131 - protein, 729 aa, Homo sapiens; identical to SEQ ID NO: 18105
  Payload ID: 3627
  Gene Symbol: CCHCR1
  Gene Name: coiled-coil alpha-helical rod protein 1
  ENSP ID: ENSP00000398934

SEQ ID NO: 18132 - protein, 171 aa, Homo sapiens; identical to SEQ ID NO: 18123
  Payload ID: 3627
  Gene Symbol: CCHCR1
  Gene Name: coiled-coil alpha-helical rod protein 1
  ENSP ID: ENSP00000399391

SEQ ID NO: 18133 - protein, 171 aa, Homo sapiens; identical to SEQ ID NO: 18111
  Payload ID: 3627
  Gene Symbol: CCHCR1
  Gene Name: coiled-coil alpha-helical rod protein 1
  ENSP ID: ENSP00000399555

SEQ ID NO: 18134 - protein, 152 aa, Homo sapiens; identical to SEQ ID NO: 18128
  Payload ID: 3627
  Gene Symbol: CCHCR1
  Gene Name: coiled-coil alpha-helical rod protein 1
  ENSP ID: ENSP00000400469

SEQ ID NO: 18135 - protein, 835 aa, Homo sapiens
  Payload ID: 3627
  Gene Symbol: CCHCR1
  Gene Name: coiled-coil alpha-helical rod protein 1
  Uniprot ID: Q8TD31
  ENSP ID: ENSP00000401039
MWPHSAGARPWASTLTGKDPRVMACWCLDGLPSGLAEPWRELWRWRSRPLHCVPPFSPLARSSRDHRNLRRRGNIDGWRQNLEPSNNVEMFPPSGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 18136 - protein, 188 aa, Homo sapiens; identical to SEQ ID NO: 18126
  Payload ID: 3627
  Gene Symbol: CCHCR1
  Gene Name: coiled-coil alpha-helical rod protein 1
  ENSP ID: ENSP00000401869

SEQ ID NO: 18137 - protein, 216 aa, Homo sapiens; identical to SEQ ID NO: 18120
  Payload ID: 3627
  Gene Symbol: CCHCR1
  Gene Name: coiled-coil alpha-helical rod protein 1
  ENSP ID: ENSP00000402432

SEQ ID NO: 18138 - protein, 256 aa, Homo sapiens; identical to SEQ ID NO: 18116
  Payload ID: 3627
  Gene Symbol: CCHCR1
  Gene Name: coiled-coil alpha-helical rod protein 1
  ENSP ID: ENSP00000403227
  MOD_RES (1)..(1): Any amino acid

SEQ ID NO: 18139 - protein, 782 aa, Homo sapiens; identical to SEQ ID NO: 18119
  Payload ID: 3627
  Gene Symbol: CCHCR1
  Gene Name: coiled-coil alpha-helical rod protein 1
  ENSP ID: ENSP00000403628

SEQ ID NO: 18140 - protein, 188 aa, Homo sapiens
  Payload ID: 3627
  Gene Symbol: CCHCR1
  Gene Name: coiled-coil alpha-helical rod protein 1
  ENSP ID: ENSP00000404715
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGRQRELEEVQRLHQEQLSSLTQAHEE

SEQ ID NO: 18141 - protein, 316 aa, Homo sapiens
  Payload ID: 3627
  Gene Symbol: CCHCR1
  Gene Name: coiled-coil alpha-helical rod protein 1
  ENSP ID: ENSP00000404757
MFPPSGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQE

SEQ ID NO: 18142 - protein, 729 aa, Homo sapiens
  Payload ID: 3627
  Gene Symbol: CCHCR1
  Gene Name: coiled-coil alpha-helical rod protein 1
  ENSP ID: ENSP00000404917
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLDTMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 18143 - protein, 118 aa, Homo sapiens; identical to SEQ ID NO: 18109
  Payload ID: 3627
  Gene Symbol: CCHCR1
  Gene Name: coiled-coil alpha-helical rod protein 1
  ENSP ID: ENSP00000405010

SEQ ID NO: 18144 - protein, 782 aa, Homo sapiens; identical to SEQ ID NO: 18119
  Payload ID: 3627
  Gene Symbol: CCHCR1
  Gene Name: coiled-coil alpha-helical rod protein 1
  ENSP ID: ENSP00000405118

SEQ ID NO: 18145 - protein, 782 aa, Homo sapiens; identical to SEQ ID NO: 18101
  Payload ID: 3627
  Gene Symbol: CCHCR1
  Gene Name: coiled-coil alpha-helical rod protein 1
  Uniprot ID: Q8TD31
  ENSP ID: ENSP00000408012

SEQ ID NO: 18146 - protein, 171 aa, Homo sapiens; identical to SEQ ID NO: 18111
  Payload ID: 3627
  Gene Symbol: CCHCR1
  Gene Name: coiled-coil alpha-helical rod protein 1
  ENSP ID: ENSP00000408031

SEQ ID NO: 18147 - protein, 316 aa, Homo sapiens
  Payload ID: 3627
  Gene Symbol: CCHCR1
  Gene Name: coiled-coil alpha-helical rod protein 1
  ENSP ID: ENSP00000408519
MFPPSGHQDVSERRLDTQRPQVTMWERDVSSDRQEPGRRGRSWGLEGSQALSQQAEVIVRQLQELRWLEEEVWLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQE

SEQ ID NO: 18148 - protein, 152 aa, Homo sapiens
  Payload ID: 3627
  Gene Symbol: CCHCR1
  Gene Name: coiled-coil alpha-helical rod protein 1
  ENSP ID: ENSP00000408590
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRWLEEEVWLLRETSLQQKMRLEAQAMELEALARAEKAGRAEAEGLRAALAG

SEQ ID NO: 18149 - protein, 316 aa, Homo sapiens; identical to SEQ ID NO: 18147
  Payload ID: 3627
  Gene Symbol: CCHCR1
  Gene Name: coiled-coil alpha-helical rod protein 1
  ENSP ID: ENSP00000409157

SEQ ID NO: 18150 - protein, 126 aa, Homo sapiens; identical to SEQ ID NO: 18112
  Payload ID: 3627
  Gene Symbol: CCHCR1
  Gene Name: coiled-coil alpha-helical rod protein 1
  ENSP ID: ENSP00000409907

SEQ ID NO: 18151 - protein, 152 aa, Homo sapiens; identical to SEQ ID NO: 18128
  Payload ID: 3627
  Gene Symbol: CCHCR1
  Gene Name: coiled-coil alpha-helical rod protein 1
  ENSP ID: ENSP00000410018

SEQ ID NO: 18152 - protein, 126 aa, Homo sapiens; identical to SEQ ID NO: 18112
  Payload ID: 3627
  Gene Symbol: CCHCR1
  Gene Name: coiled-coil alpha-helical rod protein 1
  ENSP ID: ENSP00000410052

SEQ ID NO: 18153 - protein, 152 aa, Homo sapiens; identical to SEQ ID NO: 18148
  Payload ID: 3627
  Gene Symbol: CCHCR1
  Gene Name: coiled-coil alpha-helical rod protein 1
  ENSP ID: ENSP00000412157

SEQ ID NO: 18154 - protein, 188 aa, Homo sapiens; identical to SEQ ID NO: 18140
  Payload ID: 3627
  Gene Symbol: CCHCR1
  Gene Name: coiled-coil alpha-helical rod protein 1
  ENSP ID: ENSP00000412354

SEQ ID NO: 18155 - protein, 191 aa, Homo sapiens
  Payload ID: 3627
  Gene Symbol: CCHCR1
  Gene Name: coiled-coil alpha-helical rod protein 1
  ENSP ID: ENSP00000414323
MFPPSGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAEL

SEQ ID NO: 18156 - protein, 782 aa, Homo sapiens; identical to SEQ ID NO: 18119
  Payload ID: 3627
  Gene Symbol: CCHCR1
  Gene Name: coiled-coil alpha-helical rod protein 1
  ENSP ID: ENSP00000414411

SEQ ID NO: 18157 - protein, 256 aa, Homo sapiens; identical to SEQ ID NO: 18116
  Payload ID: 3627
  Gene Symbol: CCHCR1
  Gene Name: coiled-coil alpha-helical rod protein 1
  ENSP ID: ENSP00000414578
  MOD_RES (1)..(1): Any amino acid

SEQ ID NO: 18158 - protein, 729 aa, Homo sapiens; identical to SEQ ID NO: 18142
  Payload ID: 3627
  Gene Symbol: CCHCR1
  Gene Name: coiled-coil alpha-helical rod protein 1
  ENSP ID: ENSP00000416029

SEQ ID NO: 18159 - protein, 115 aa, Homo sapiens
  Payload ID: 3627
  Gene Symbol: CCHCR1
  Gene Name: coiled-coil alpha-helical rod protein 1
  ENSP ID: ENSP00000420911
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETS

SEQ ID NO: 18160 - protein, 158 aa, Homo sapiens
  Payload ID: 3627
  Gene Symbol: CCHCR1
  Gene Name: coiled-coil alpha-helical rod protein 1
  ENSP ID: ENSP00000420941
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRK

SEQ ID NO: 18161 - protein, 159 aa, Homo sapiens
  Payload ID: 3627
  Gene Symbol: CCHCR1
  Gene Name: coiled-coil alpha-helical rod protein 1
  ENSP ID: ENSP00000421393
MFPPSGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTS

SEQ ID NO: 18162 - protein, 80 aa, Homo sapiens
  Payload ID: 3627
  Gene Symbol: CCHCR1
  Gene Name: coiled-coil alpha-helical rod protein 1
  ENSP ID: ENSP00000421523
MFPPSGSTGLIPPSHFQARPLSTLPRMAPTWLSDIPLVQPPGHQDVSERRLDTQRPQVTMWERDVSSDRQEPGRRGSCPL

SEQ ID NO: 18163 - protein, 126 aa, Homo sapiens
  Payload ID: 3627
  Gene Symbol: CCHCR1
  Gene Name: coiled-coil alpha-helical rod protein 1
  ENSP ID: ENSP00000421992
MFPPSGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEE

SEQ ID NO: 18164 - protein, 80 aa, Homo sapiens
  Payload ID: 3627
  Gene Symbol: CCHCR1
  Gene Name: coiled-coil alpha-helical rod protein 1
  ENSP ID: ENSP00000422000
MWPHSAGARPWASTLTGKDPRVMACWCLDGLPSGLAEPWRELWRWRSRPLHCVPPFSPLARSSRDHRNLRRRGLSLWKVA

SEQ ID NO: 18165 - protein, 80 aa, Homo sapiens; identical to SEQ ID NO: 18162
  Payload ID: 3627
  Gene Symbol: CCHCR1
  Gene Name: coiled-coil alpha-helical rod protein 1
  ENSP ID: ENSP00000422503

SEQ ID NO: 18166 - protein, 41 aa, Homo sapiens
  Payload ID: 3627
  Gene Symbol: CCHCR1
  Gene Name: coiled-coil alpha-helical rod protein 1
  ENSP ID: ENSP00000424164
MFPPSGSTGLIPPSHFQARPLSTLPRMAPTWLSDIPLVQPP

SEQ ID NO: 18167 - protein, 96 aa, Homo sapiens
  Payload ID: 3627
  Gene Symbol: CCHCR1
  Gene Name: coiled-coil alpha-helical rod protein 1
  ENSP ID: ENSP00000424335
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVR

SEQ ID NO: 18168 - protein, 118 aa, Homo sapiens; identical to SEQ ID NO: 18109
  Payload ID: 3627
  Gene Symbol: CCHCR1
  Gene Name: coiled-coil alpha-helical rod protein 1
  ENSP ID: ENSP00000425377

SEQ ID NO: 18169 - protein, 36 aa, Homo sapiens
  Payload ID: 3627
  Gene Symbol: CCHCR1
  Gene Name: coiled-coil alpha-helical rod protein 1
  ENSP ID: ENSP00000425435
MFPPSGSTGLIPPSHFQARPLSTLPRMAPTWLSDIP

SEQ ID NO: 18170 - protein, 139 aa, Homo sapiens
  Payload ID: 3627
  Gene Symbol: CCHCR1
  Gene Name: coiled-coil alpha-helical rod protein 1
  ENSP ID: ENSP00000425595
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAG

SEQ ID NO: 18171 - protein, 140 aa, Homo sapiens
  Payload ID: 3627
  Gene Symbol: CCHCR1
  Gene Name: coiled-coil alpha-helical rod protein 1
  ENSP ID: ENSP00000425682
MAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQR

SEQ ID NO: 18172 - protein, 44 aa, Homo sapiens
  Payload ID: 3627
  Gene Symbol: CCHCR1
  Gene Name: coiled-coil alpha-helical rod protein 1
  ENSP ID: ENSP00000426883
MFPPSGHQDVSERRLDTQRPQVTMWERDVSSDRQEPGRRGSCPL

SEQ ID NO: 18173 - protein, 870 aa, Homo sapiens
  Payload ID: 3627
  Gene Symbol: CCHCR1
  Gene Name: coiled-coil alpha-helical rod protein 1
  ENSP ID: ENSP00000479660
MWPHSAGARPWASTLTGKDPRVMACWCLDGLPSGLAEPWRELWRWRSRPLHCVPPFSPLARSSRDHRNLRRRGNIDGRQNLEPSNNVEMFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRWLEEEVWLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRWWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQCQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSCNPQMSS

SEQ ID NO: 18174 - protein, 870 aa, Homo sapiens
  Payload ID: 3627
  Gene Symbol: CCHCR1
  Gene Name: coiled-coil alpha-helical rod protein 1
  ENSP ID: ENSP00000483182
MWPHSAGARPWASTLTGKDPRVMACWCLDGLPSGLAEPWRELWRWRSRPLHCVPPFSPLARSSRDHRNLRRRGNIDGRQNLEPSNNVEMFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLDTMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 18175 - protein, 870 aa, Homo sapiens; identical to SEQ ID NO: 18174
  Payload ID: 3627
  Gene Symbol: CCHCR1
  Gene Name: coiled-coil alpha-helical rod protein 1
  ENSP ID: ENSP00000483995

SEQ ID NO: 18176 - protein, 870 aa, Homo sapiens; identical to SEQ ID NO: 18173
  Payload ID: 3627
  Gene Symbol: CCHCR1
  Gene Name: coiled-coil alpha-helical rod protein 1
  ENSP ID: ENSP00000484259

SEQ ID NO: 18177 - protein, 951 aa, Homo sapiens
  Payload ID: 3628
  Gene Symbol: CC2D1A
  Gene Name: coiled-coil and C2 domain containing 1A
  Uniprot ID: Q6P1N0
  ENSP ID: ENSP00000313601
MHKRKGPPGPPGRGAAAARQLGLLVDLSPDGLMIPEDGANDEELEAEFLALVGGQPPALEKLKGKGPLPMEAIEKMASLCMRDPDEDEEEGTDEDDLEADDDLLAELNEVLGEEQKASETPPPVAQPKPEAPHPGLETTLQERLALYQTAIESARQAGDSAKMRRYDRGLKTLENLLASIRKGNAIDEADIPPPVAIGKGPASTPTYSPAPTQPAPRIASAPEPRVTLEGPSATAPASSPGLAKPQMPPGPCSPGPLAQLQSRQRDYKLAALHAKQQGDTTAAARHFRVAKSFDAVLEALSRGEPVDLSCLPPPPDQLPPDPPSPPSQPPTPATAPSTTEVPPPPRTLLEALEQRMERYQVAAAQAKSKGDQRKARMHERIVKQYQDAIRAHKAGRAVDVAELPVPPGFPPIQGLEATKPTQQSLVGVLETAMKLANQDEGPEDEEDEVPKKQNSPVAPTAQPKAPPSRTPQSGSAPTAKAPPKATSTRAQQQLAFLEGRKKQLLQAALRAKQKNDVEGAKMHLRQAKGLEPMLEASRNGLPVDITKVPPAPVNKDDFALVQRPGPGLSQEAARRYGELTKLIRQQHEMCLNHSNQFTQLGNITETTKFEKLAEDCKRSMDILKQAFVRGLPTPTARFEQRTFSVIKIFPDLSSNDMLLFIVKGINLPTPPGLSPGDLDVFVRFDFPYPNVEEAQKDKTSVIKNTDSPEFKEQFKLCINRSHRGFRRAIQTKGIKFEVVHKGGLFKTDRVLGTAQLKLDALEIACEVREILEVLDGRRPTGGRLEVMVRIREPLTAQQLETTTERWLVIDPVPAAVPTQVAGPKGKAPPVPAPARESGNRSARPLHSLSVLAFDQERLERKILALRQARRPVPPEVAQQYQDIMQRSQWQRAQLEQGGVGIRREYAAQLERQLQFYTEAARRLGNDGSRDAAKEALYRRNLVESELQRLRR

SEQ ID NO: 18178 - protein, 378 aa, Homo sapiens
  Payload ID: 3628
  Gene Symbol: CC2D1A
  Gene Name: coiled-coil and C2 domain containing 1A
  ENSP ID: ENSP00000465376
  MOD_RES (1)..(1): Any amino acid
XQAGDSAKMRRYDRGLKTLENLLASIRKGNAIDEADIPPPVAIGKGPASTPTYSPAPTQPAPRIASAPEPRVTLEGPSATAPASSPGLAKPQMPPGPCSPGPLAQLQSRQRDYKLAALHAKQQGDTTAAARHFRVAKSFDAVLEALSRGEPVDLSCLPPPPDQLPPDPPSPPSQPPTPATAPSTTEVPPPPRTLLEALEQRMERYQVAAAQAKSKGDQRKARMHERIVKQYQDAIRAHKAGRAVDVAELPVPPAEQPCGPHSPAQSPTLKNSPVGISPNSQSAPQSHIHQSPAAAGLPRGPQEAAPAGRTASQAEKRRGGCQDAPAPSQGTGAYAGGLAQWAACGHHQGAACPCQQGRLCPGPAAWPGSVSGGRPALW

SEQ ID NO: 18179 - protein, 405 aa, Homo sapiens
  Payload ID: 3628
  Gene Symbol: CC2D1A
  Gene Name: coiled-coil and C2 domain containing 1A
  ENSP ID: ENSP00000466586
  MOD_RES (1)..(1): Any amino acid
XQVPPAPVNKDDFALVQRPGPGLSQEAARRYGELTKLIRQQHEMCLNHSNQFTQLGNITETTKFEKLAEDCKRSMDILKQAFVRGLPTPTARFEQRTFSVIKIFPDLSSNDMLLFIVKGINLPTPPGLSPGDLDVFVRFDFPYPNVEEAQKDKTSVIKNTDSPEFKEQFKLCINRSHRGFRRAIQTKGIKFEVVHKGGLFKTDRVLGTAQLKLDALEIACEVREILEVLDGRRPTGGRLEVMVRIREPLTAQQLETTTERWLVIDPVPAAVPTVAGPKGKAPPVPAPARESGNRSARPLHSLSVLAFDQERLERKILALRQARRPVPPEVAQQYQDIMQRSQWQRAQLEQGGVGIRREYAAQLERQLQFYTEAARRLGNDGSRDAAKEALYRRNLVESELQRLRR

SEQ ID NO: 18180 - protein, 950 aa, Homo sapiens
  Payload ID: 3628
  Gene Symbol: CC2D1A
  Gene Name: coiled-coil and C2 domain containing 1A
  Uniprot ID: Q6P1N0
  ENSP ID: ENSP00000467526
MHKRKGPPGPPGRGAAAARQLGLLVDLSPDGLMIPEDGANDEELEAEFLALVGGQPPALEKLKGKGPLPMEAIEKMASLCMRDPDEDEEEGTDEDDLEADDDLLAELNEVLGEEQKASETPPPVAQPKPEAPHPGLETTLQERLALYQTAIESARQAGDSAKMRRYDRGLKTLENLLASIRKGNAIDEADIPPPVAIGKGPASTPTYSPAPTQPAPRIASAPEPRVTLEGPSATAPASSPGLAKPQMPPGPCSPGPLAQLQSRQRDYKLAALHAKQQGDTTAAARHFRVAKSFDAVLEALSRGEPVDLSCLPPPPDQLPPDPPSPPSQPPTPATAPSTTEVPPPPRTLLEALEQRMERYQVAAAQAKSKGDQRKARMHERIVKQYQDAIRAHKAGRAVDVAELPVPPGFPPIQGLEATKPTQQSLVGVLETAMKLANQDEGPEDEEDEVPKKQNSPVAPTAQPKAPPSRTPQSGSAPTAKAPPKATSTRAQQQLAFLEGRKKQLLQAALRAKQKNDVEGAKMHLRQAKGLEPMLEASRNGLPVDITKVPPAPVNKDDFALVQRPGPGLSQEAARRYGELTKLIRQQHEMCLNHSNQFTQLGNITETTKFEKLAEDCKRSMDILKQAFVRGLPTPTARFEQRTFSVIKIFPDLSSNDMLLFIVKGINLPTPPGLSPGDLDVFVRFDFPYPNVEEAQKDKTSVIKNTDSPEFKEQFKLCINRSHRGFRRAIQTKGIKFEVVHKGGLFKTDRVLGTAQLKLDALEIACEVREILEVLDGRRPTGGRLEVMVRIREPLTAQQLETTTERWLVIDPVPAAVPTVAGPKGKAPPVPAPARESGNRSARPLHSLSVLAFDQERLERKILALRQARRPVPPEVAQQYQDIMQRSQWQRAQLEQGGVGIRREYAAQLERQLQFYTEAARRLGNDGSRDAAKEALYRRNLVESELQRLRR

SEQ ID NO: 18181 - protein, 852 aa, Homo sapiens
  Payload ID: 3629
  Gene Symbol: CC2D1B
  Gene Name: coiled-coil and C2 domain containing 1B
  Uniprot ID: Q5T0F9
  ENSP ID: ENSP00000284376
MMPGPRPRKGPQARGQGVAAAKQMGLFMEFGPEDMLLGMDEAEDDEDLEAELLALTGEAQTTGKKPAPKGQAPLPMAHIEKLAADCMRDVEEEEEEEGLEEDAELLTELQEVLGVDEETEPLDGDEVADPGGSEEENGLEDTEPPVQTAVLTASAPAAQAGASQGLHALLEERIHNYREAAASAKEAGEAAKARRCERGLKTLESQLASVRRGRKINEDEIPPPVALGKRPLAPQEPANRSPETDPPAPPALESDNPSQPETSLPGISAQPVSDLDPDPRALLSSRQREYKVAALSAKRAGELDRARELMRIGKRFGAVLEALEKGQPVDLSAMPPAPEDLKPQQASQAPTAPSVIPPAVERVQPVMAPDVPATPVAPTESQTVLDALQQRLNKYREAGIQARSGGDERKARMHERIAKQYQDAIRAHRAGRKVNFAELPVPPGFPPIPGLESTMGVEEDAVAATLAAAEKLASAEDSAPADKDEDEGEPPAQAPVAKKPARPTVPSSQRLPEPRASSSKESPSPSVREQLALLEARKLQYQRAALQAKRSQDLEQAKAYLRVAKWLEAQIIQARSGRPVDLSKVPSPLTDEEGDFILIHHEDLRLSQKAEEVYAQLQKMLLEQQEKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEVLDGRKPTGGKLEVKVRLREPLSGQDVQMVTENWLVLEPRGL

SEQ ID NO: 18182 - protein, 858 aa, Homo sapiens
  Payload ID: 3629
  Gene Symbol: CC2D1B
  Gene Name: coiled-coil and C2 domain containing 1B
  Uniprot ID: Q5T0F9
  ENSP ID: ENSP00000360642
MMPGPRPRKGPQARGQGVAAAKQMGLFMEFGPEDMLLGMDEAEDDEDLEAELLALTGEAQTTGKKPAPKGQAPLPMAHIEKLAADCMRDVEEEEEEEGLEEDAELLTELQEVLGVDEETEPLDGDEVADPGGSEEENGLEDTEPPVQTAVLTASAPAAQAGASQGLHALLEERIHNYREAAASAKEAGEAAKARRCERGLKTLESQLASVRRGRKINEDEIPPPVALGKRPLAPQEPANRSPETDPPAPPALESDNPSQPETSLPGISAQPVSDLDPDPRALLSSRQREYKVAALSAKRAGELDRARELMRIGKRFGAVLEALEKGQPVDLSAMPPAPEDLKPQQASQAPTAPSVIPPAVERVQPVMAPDVPATPVAPTESQTVLDALQQRLNKYREAGIQARSGGDERKARMHERIAKQYQDAIRAHRAGRKVNFAELPVPPGFPPIPGLESTMGVEEDAVAATLAAAEKLASAEDSAPADKDEDEPPGHLQGEPPAQAPVAKKPARPTVPSSQRLPEPRASSSKESPSPSVREQLALLEARKLQYQRAALQAKRSQDLEQAKAYLRVAKWLEAQIIQARSGRPVDLSKVPSPLTDEEGDFILIHHEDLRLSQKAEEVYAQLQKMLLEQQEKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEVLDGRKPTGGKLEVKVRLREPLSGQDVQMVTENWLVLEPRGL

SEQ ID NO: 18183 - protein, 628 aa, Homo sapiens
  Payload ID: 3629
  Gene Symbol: CC2D1B
  Gene Name: coiled-coil and C2 domain containing 1B
  ENSP ID: ENSP00000395921
  MOD_RES (1)..(1): Any amino acid
XKINEDEIPPPVALGKRPLAPQEPANRSPETDPPAPPALESDNPSQPETSLPGISAQPVSDLDPDPRALLSSRQREYKVAALSAKRAGELDRARELMRIGKRFGAVLEALEKGQPVDLSAMPPAPEDLKPQQASQAPTAPSVIPPAVERVQPVMAPDVPATPVAPTESQTVLDALQQRLNKYREAGIQARSGGDERKARMHERIAKQYQDAIRAHRAGRKVNFAELPVPPGFPPIPGLESTMGVEEDAVAATLAAAEKLASAEDSAPADKDEDEGEPPAQAPVAKKPARPTVPSSQRLPEPRASSSKESPSPSVREQLALLEARKLQYQRAALQAKRSQDLEQAKAYLRVAKWLEAQIIQARSGRPVDLSKVPSPLTDEEGDFILIHHEDLRLSQKAEEVYAQLQKMLLEQQEKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEVLDGRKPTGGKLEVKPMASTRRGVRPRLCRR

SEQ ID NO: 18184 - protein, 672 aa, Homo sapiens
  Payload ID: 3629
  Gene Symbol: CC2D1B
  Gene Name: coiled-coil and C2 domain containing 1B
  ENSP ID: ENSP00000402440
  MOD_RES (1)..(1): Any amino acid
XGASQGLHALLEERIHNYREAAASAKEAGEAAKARRCERGLKTLESQLASVRRGRKINEDEIPPPVALGKRPLAPQEPANRSPETDPPAPPALESDPDPRALLSSRQREYKVAALSAKRAGELDRARELMRIGKRFGAVLEALEKGQPVDLSAMPPAPEDLKPQQASQAPTAPSVIPPAVERVQPVMAPDVPATPVAPTESQTVLDALQQRLNKYREAGIQARSGGDERKARMHERIAKQYQDAIRAHRAGRKVNFAELPVPPGFPPIPGLESTMGVEEDAVAATLAAAEKLASAEDSAPADKDEDEGEPPAQAPVAKKPARPTVPSSQRLPEPRASSSKESPSPSVREQLALLEARKLQYQRAALQAKRSQDLEQAKAYLRVAKWLEAQIIQARSGRPVDLSKVPSPLTDEEGDFILIHHEDLRLSQKAEEVYAQLQKMLLEQQEKCLLFSKQFMHQGNVAETTRFEKLAQDRKKQLEILQLAQAQGLDPPTHHFELKTFQTVRIFSELNSTEMHLIIVRGMNLPAPPGVTPDDLDAFVRFEFHYPNSDQAQKSKTAVVKNTNSPEFDQLFKLNINRNHRGFKRVIQSKGIKFEIFHKGSFFRSDKLVGTAHLKLERLENECEIREIVEVLDGRKPTGGKLEVKVRLREPLSGQDVQMVTENWLVLEPRGL

SEQ ID NO: 18185 - protein, 1453 aa, Homo sapiens
  Payload ID: 3630
  Gene Symbol: CC2D2A
  Gene Name: coiled-coil and C2 domain containing 2A
  ENSP ID: ENSP00000374303
  MOD_RES (1)..(1): Any amino acid
XVPPGFPSAEEAYNFFTFNFDPEPEGSEEKPKARHRAGTNQEEEEGEEEEPPAQGGGKEMDEEELLNGDDAEDFLLGLDHVADDFVAVRPADYESIHDRLQMEREMLFIPSRQTVPTYKKLPENVQPRFLEDEGLYTGVRPEVARTNQNIMENRLLMQDPERRWFGDDGRILALPNPIKPFPSRPPVLTQEQSIKAELETLYKKAVKYVHSSQHVIRSGDPPGNFQLDIDISGLIFTHHPCFSREHVLAAKLAQLYDQYLARHQRNKAKFLTDKLQALRNAVQTGLDPEKPHQSLDTIQKTINEYKSEIRQTRKFRDAEQEKDRTLLKTIIKVWKEMKSLREFQRFTNTPLKLVLRKEKADQKADEEAYEAEIQAEISELLEEHTEEYAQKMEEYRTSLQQWKAWRKVQRAKKKKRKQAAEEHPGDEIAEPYPEEDLVKPSPPEPTDRAVIEQEVRERAAQSRRRPWEPTLVPELSLAGSVTPNDQCPRAEVSRREDVKKRSVYLKVLFNNKEVSRTVSRPLGADFRVHFGQIFNLQIVNWPESLTLQVYETVGHSSPTLLAEVFLPIPETTVVTGRAPTEEVEFSSNQHVTLDHEGVGSGVPFSFEADGSNQLTLMTSGKVSHSVAWAIGENGIPLIPPLSQQNIGFRSALKKADAISSIGTSGLTDMKKLAKWAAESKLDPNDPNNAPLMQLISVATSGESYVPDFFRLEQLQQEFNFVSDQELNRSKRFRLLHLRSQEVPEFRNYKQVPVYDREIMEKVFQDYEKRLRDRNVIETKEHIDTHRAIVAKYLQQVRESVINRFLIAKQYFLLADMIVEEEVPNISSEGSGILGLSLFKLAEQKRPLRPRRKGRKKVTAQNLSDGDIKLLVNIVRAYDIPVRKPAVSKFQQPSRSSRMFSEKHAASPSTYSPTHNADYPLGQVLVRPFVEVSFQRTVCHTTTAEGPNPSWNEELELPFRAPNGDYSTASLQSVKDVVFINIFDEVLHDVLEDDRERGSGIHTRIERHWLGCVKMPFSTIYFQARIDGTFKIDIPPVLLGYSKERNMILERGFDSVRSLSEGSYITLFITIEPQLVPGESIREKMSNMLKKFESQEDEKLLQATEKFQAECALKFPNRQCLTTVIDISGKTVFITRYLKPLNPPQELLNVYPNNLQATAELVARYVSLIPFLPDTVSFGGICDLWSTSDQFLDLLAGDEEEHAVLLCNYFLSLGKKAWLLMGNAIPEGPTAYVLTWEQGRYLIWNPCSGHFYGQFDTFCPLKNVGCLIGPDNIWFNIQRYESPLRINFDVTRPKLWKSFFSRSLPYPGLSSVQPEELIYQRSDKAAAAELQDRIEKILKEKIMDWRPRHLTRWNRYCTSTLRHFLPLLEKSQGEDVEDDHRAELLKQLGDYRFSGFPLHMPYSEVKPLIDAVYSTGVHNIDVPNVEFALAVYIHPYPKNVLSVWIYVASLIRNR

SEQ ID NO: 18186 - protein, 122 aa, Homo sapiens
  Payload ID: 3630
  Gene Symbol: CC2D2A
  Gene Name: coiled-coil and C2 domain containing 2A
  Uniprot ID: Q9P2K1
  ENSP ID: ENSP00000401154
MNPREEKVKIITEEFIENDEDADMGRQNKNSKVRRQPRKKQKPTPFSRACWQILPHLSAGVPLLGWEHPVQGKSFQATNCCPQGNGVRKIPPWQPPGACAGGAQDPPPEYDSPERPTERAGC

SEQ ID NO: 18187 - protein, 1620 aa, Homo sapiens
  Payload ID: 3630
  Gene Symbol: CC2D2A
  Gene Name: coiled-coil and C2 domain containing 2A
  Uniprot ID: Q9P2K1
  ENSP ID: ENSP00000403465
MNPREEKVKIITEEFIENDEDADMGRQNKNSKVRRQPRKKQPPTAVPKEMVSEKSHLGNPQEPVQEEPKTRLLSMTVRRGPRSLPPIPSTSRTGFAEFSMRGRMREKLQAARSKAESALLQEIPTPRPRRLRSPSKKELETEFGTEPGKEVERTQQEVDSQSYSRVKFHDSARKIKPKPQVPPGFPSAEEAYNFFTFNFDPEPEGSEEKPKARHRAGTNQEEEEGEEEEPPAQGGGKEMDEEELLNGDDAEDFLLGLDHVADDFVAVRPADYESIHDRLQMEREMLFIPSRQTVPTYKKLPENVQPRFLEDEGLYTGVRPEVARTNQNIMENRLLMQDPERRWFGDDGRILALPNPIKPFPSRPPVLTQEQSIKAELETLYKKAVKYVHSSQHVIRSGDPPGNFQLDIDISGLIFTHHPCFSREHVLAAKLAQLYDQYLARHQRNKAKFLTDKLQALRNAVQTGLDPEKPHQSLDTIQKTINEYKSEIRQTRKFRDAEQEKDRTLLKTIIKVWKEMKSLREFQRFTNTPLKLVLRKEKADQKADEEAYEAEIQAEISELLEEHTEEYAQKMEEYRTSLQQWKAWRKVQRAKKKKRKQAAEEHPGDEIAEPYPEEDLVKPSPPEPTDRAVIEQEVRERAAQSRRRPWEPTLVPELSLAGSVTPNDQCPRAEVSRREDVKKRSVYLKVLFNNKEVSRTVSRPLGADFRVHFGQIFNLQIVNWPESLTLQVYETVGHSSPTLLAEVFLPIPETTVVTGRAPTEEVEFSSNQHVTLDHEGVGSGVPFSFEADGSNQLTLMTSGKVSHSVAWAIGENGIPLIPPLSQQNIGFRSALKKADAISSIGTSGLTDMKKLAKWAAESKLDPNDPNNAPLMQLISVATSGESYVPDFFRLEQLQQEFNFVSDQELNRSKRFRLLHLRSQEVPEFRNYKQVPVYDREIMEKVFQDYEKRLRDRNVIETKEHIDTHRAIVAKYLQQVRESVINRFLIAKQYFLLADMIVEEEVPNISILGLSLFKLAEQKRPLRPRRKGRKKVTAQNLSDGDIKLLVNIVRAYDIPVRKPAVSKFQQPSRSSRMFSEKHAASPSTYSPTHNADYPLGQVLVRPFVEVSFQRTVCHTTTAEGPNPSWNEELELPFRAPNGDYSTASLQSVKDVVFINIFDEVLHDVLEDDRERGSGIHTRIERHWLGCVKMPFSTIYFQARIDGTFKIDIPPVLLGYSKERNMILERGFDSVRSLSEGSYITLFITIEPQLVPGESIREKFESQEDEKLLQATEKFQAECALKFPNRQCLTTVIDISGKTVFITRYLKPLNPPQELLNVYPNNLQATAELVARYVSLIPFLPDTVSFGGICDLWSTSDQFLDLLAGDEEEHAVLLCNYFLSLGKKAWLLMGNAIPEGPTAYVLTWEQGRYLIWNPCSGHFYGQFDTFCPLKNVGCLIGPDNIWFNIQRYESPLRINFDVTRPKLWKSFFSRSLPYPGLSSVQPEELIYQRSDKAAAAELQDRIEKILKEKIMDWRPRHLTRWNRYCTSTLRHFLPLLEKSQGEDVEDDHRAELLKQLGDYRFSGFPLHMPYSEVKPLIDAVYSTGVHNIDVPNVEFALAVYIHPYPKNVLSVWIYVASLIRNR

SEQ ID NO: 18188 - protein, 1620 aa, Homo sapiens; identical to SEQ ID NO: 18187
  Payload ID: 3630
  Gene Symbol: CC2D2A
  Gene Name: coiled-coil and C2 domain containing 2A
  Uniprot ID: Q9P2K1
  ENSP ID: ENSP00000421809

SEQ ID NO: 18189 - protein, 588 aa, Homo sapiens
  Payload ID: 3630
  Gene Symbol: CC2D2A
  Gene Name: coiled-coil and C2 domain containing 2A
  ENSP ID: ENSP00000422875
MNPREEKVKIITEEFIENDEDADMGRQNKNSKVRRQPRKKQPPTAVPKEMVSEKSHLGNPQEPVQEEPKTRLLSMTVRRGPRSLPPIPSTSRTGFAEFSMRGRMREKLQAARSKAESALLQEIPTPRPRRLRSPSKKELETEFGTEPGKEVERTQQEVDSQSYSRVKFHDSARKIKPKPQVPPGFPSAEEAYNFFTFNFDPEPEGSEEKPKARHRAGTNQEEEEGEEEEPPAQGGGKEMDEEELLNGDDAEDFLLGLDHVADDFVAVRPADYESIHDRLQMEREMLFIPSRQTVPTYKKLPENVQPRFLEDEGLYTGVRPEVARTNQNIMENRLLMQDPERRWFGDDGRILALPNPIKPFPSRPPVLTQEQSIKAELETLYKKAVKYVHSSQHVIRSGDPPGNFQLDIDISGLIFTHHPCFSREHVLAAKLAQLYDQYLARHQRNKAKFLTDKLQALRNAVQTGLDPEKPHQSLDTIQKTINEYKSEIRQTRKFRDAEQEKDRTLLKTIIKVWKEMKSLREFQRFTNTPLKLVLRKEKADQKADEEAYEAEIQAEISELLEEHTEEYAQKMEEYRTSLQQWKAWRKVQ

SEQ ID NO: 18190 - protein, 903 aa, Homo sapiens
  Payload ID: 3630
  Gene Symbol: CC2D2A
  Gene Name: coiled-coil and C2 domain containing 2A
  ENSP ID: ENSP00000422931
  MOD_RES (1)..(1): Any amino acid
XLLEEHTEEYAQKMEEYRTSLQQWKAWRKVQRAKKKKRKQAAEEHPGDEIAEPYPEEDLVKPSPPEPTDRAVIEQEVRERAAQSRRRPWEPTLVPELSLAGSVTPNDQCPRAEVSRREDVKKRSVYLKVLFNNKEVSRTVSRPLGADFRVHFGQIFNLQIVNWPESLTLQVYETVGHSSPTLLAEVFLPIPETTVVTGRAPTEEVEFSSNQHVTLDHEGVGSGVPFSFEADGSNQLTLMTSGKVSHSVAWAIGENGIPLIPPLSQQNIGFRSALKKADAISSIGTSGLTDMKKLAKWAAESKLDPNDPNNAPLMQLISVATSGESYVPDFFRLEQLQQEFNFVSDQELNRSKRFRLLHLRSQEVPEFRNYKQVPVYDREIMEKVFQDYEKRLRDRNVIETKEHIDTHRAIVAKYLQQVRESVINRFLIAKQYFLLADMIVEEEVPNISILGLSLFKLAEQKRPLRPRRKGRKKVTAQNLSDGDIKLLVNIVRAYDIPVRKPAVSKFQQPSRSSRMFSEKHAASPSTYSPTHNADYPLGQVLVRPFVEVSFQRTVCHTTTAEGPNPSWNEELELPFRAPNGDYSTASLQSVKDVVFINIFDEVLHDVLEDDRERGSGIHTRIERHWLGCVKMPFSTIYFQARIDGTFKIDIPPVLLGYSKERNMILERGFDSVRSLSEGSYITLFITIEPQLVPGESIREKFESQEDEKLLQATEKFQAECALKFPNRQCLTTVIDISGKTVFITRYLKPLNPPQELLNVYPNNLQATAELVARYVSLIPFLPDTVSFGGICDLWSTSDQFLDLLAGDEEEHAVLLCNYFLSLGKKAWLLMGNAIPEGPTAYVLTWEQGRYLIWNPCSGHFYGQFDTFCPLKNVGCLIGPDNAQAMEIFLFKKPSISWPFQCSA

SEQ ID NO: 18191 - protein, 111 aa, Homo sapiens
  Payload ID: 3630
  Gene Symbol: CC2D2A
  Gene Name: coiled-coil and C2 domain containing 2A
  Uniprot ID: Q9P2K1
  ENSP ID: ENSP00000424368
MNPREEKVKIITEEFIENDEDADMGRQNKNSKVRRQPRKKQPPTAVPKEMVSEKSHLGNPQEPVQEEPKTRLLSMTVRRGPRRELVVKKSLGRPGTVTHVCNPSTLEGRGG

SEQ ID NO: 18192 - protein, 73 aa, Homo sapiens
  Payload ID: 3630
  Gene Symbol: CC2D2A
  Gene Name: coiled-coil and C2 domain containing 2A
  ENSP ID: ENSP00000426109
MNPREEKVKIITEEFIENDEDADMGRQNKNSKVRRQPRKKQAEANSFLPSLLADPPPPLRRSSPPRLGASRAG

SEQ ID NO: 18193 - protein, 122 aa, Homo sapiens; identical to SEQ ID NO: 18186
  Payload ID: 3630
  Gene Symbol: CC2D2A
  Gene Name: coiled-coil and C2 domain containing 2A
  Uniprot ID: Q9P2K1
  ENSP ID: ENSP00000426846

SEQ ID NO: 18194 - protein, 111 aa, Homo sapiens; identical to SEQ ID NO: 18191
  Payload ID: 3630
  Gene Symbol: CC2D2A
  Gene Name: coiled-coil and C2 domain containing 2A
  Uniprot ID: Q9P2K1
  ENSP ID: ENSP00000427221

SEQ ID NO: 18195 - protein, 142 aa, Homo sapiens
  Payload ID: 3630
  Gene Symbol: CC2D2A
  Gene Name: coiled-coil and C2 domain containing 2A
  ENSP ID: ENSP00000488534
  MOD_RES (1)..(1): Any amino acid
XDTFCPLKNVGCLIGPDNPEELIYQRSDKAAAAELQDRIEKILKEKIMDWRPRHLTRWNRYCTSTLRHFLPLLEKSQGEDVEDDHRAELLKQLGDYRFSGFPLHMPYSEVKPLIDAVYSTGVHNIDVPNVEFALAVYIHPYP

SEQ ID NO: 18196 - protein, 129 aa, Homo sapiens
  Payload ID: 3630
  Gene Symbol: CC2D2A
  Gene Name: coiled-coil and C2 domain containing 2A
  ENSP ID: ENSP00000488669
KPTPFSRACWQILPHLSAGVPLLGWEHPVQGKSFQATNCCPQGNGVRKIPPWQPPGACAGGAQDPPPEYDSPERPTELTSNSFNFQNRLCRIFHEGTHEGEIASSEVQSRKCIAAGNPHSSAQTLTKSQ

SEQ ID NO: 18197 - protein, 322 aa, Homo sapiens
  Payload ID: 3631
  Gene Symbol: CC2D2B
  Gene Name: coiled-coil and C2 domain containing 2B
  Uniprot ID: Q6DHV5
  ENSP ID: ENSP00000343747
MMTEKHEDHCLKSCSGHSYIRKNWLGCIVFPFSALLQQSEFLDQTEVLQRAQIFKKNCKAMFPNRRIVTTVFNDEGIQFLVTRYIKALNPPQQLLDIFLHNSNATFDLIARFVSLIPFVPNTPDENDGSDIWMTSEHCISLAIGNKEEHAILLCNFFLYFGKKALVLLGTSVLEGHVAYVVTQETNEYLLWNPSTGQCYKQFDPFCPLKSVDCLFDDRNVWFNIQQNNTPMAVFFDYSKESFWKQLLPKNVQGTKIQSIQVTGFPIQMPYIDVQSIIDAVYQTGIHSAEFPQTEFALAVYIHPYPNNILSVWVYLASLVQHQ

SEQ ID NO: 18198 - protein, 401 aa, Homo sapiens
  Payload ID: 3631
  Gene Symbol: CC2D2B
  Gene Name: coiled-coil and C2 domain containing 2B
  Uniprot ID: Q6DHV5
  ENSP ID: ENSP00000386988
MMTEKHEDHCLKSCSGHSYIRKNWLGCIVFPFSALLQQSEFLDQTEVLQRAQIFKKNCKAMFPNRRIVTTVFNDEGIQFLVTRYIKALNPPQQLLDIFLHNSNATFDLIARFVSLIPFVPNTPDENDGSDIWMTSEHCISLAIGNKEEHAILLCNFFLYFGKKALVLLGTSVLEGHVAYVVTQETNEYLLWNPSTGQCYKQFDPFCPLKSVDCLFDDRNVWFNIQQNNTPMAVFFDYSKESFWKQLLPKNVQGTKIQSIQPEEIIYFETDKSMVEDLRNRIERTLKSKVMEWRPKHPTHWNRQCTFILRQILPKLEFGIGSFVSSEGDNEFERILQFYWVTGFPIQMPYIDVQSIIDAVYQTGIHSAEFPQTEFALAVYIHPYPNNILSVWVYLASLVQHQ

SEQ ID NO: 18199 - protein, 195 aa, Homo sapiens
  Payload ID: 3631
  Gene Symbol: CC2D2B
  Gene Name: coiled-coil and C2 domain containing 2B
  ENSP ID: ENSP00000391834
MMTEKHEDHCLKSCSGHSYIRKNWLGCIVFPFSALLQQSEISGTFQVTIPPVLLGYTWSNTYVFPKEDSNEQNLKECTFLNIFATIEPQISYVTCNPTLDKFLDQTEVLQRAQIFKKNCKAMFPNRRIVTTVFNDEGIQFLVTRYIKALNPPQQLLDIFLHNSNATFDLIARFVSLIPFVPNTPDENDGSDIWMT

SEQ ID NO: 18200 - protein, 550 aa, Homo sapiens
  Payload ID: 3632
  Gene Symbol: CCDC102A
  Gene Name: coiled-coil domain containing 102A
  Uniprot ID: Q96A19
  ENSP ID: ENSP00000258214
MSHGPSPRLAESPQLSKGSLLTILGSPSPERMGPADSLPPTPPSGTPSPGPPPALPLPPAPALLADGDWESREELRLRELEEARARAAQMEKTMRRWSDCTANWREKWSKVRAERNRAREEVRQLRQRLDALTKELAGARRERQEAQGECEARGRELARLRGARGVADQTRDGPEPEAEREPVRDVGSERPPGSQELELVESLLKSMPEESEDCWEARSLGAGGPRGSSGRQERSRLPWEDTAATEEEASKLTALRLRLDESQKVLLKEREDKLALSRNIEKLEGELSQWKIKYEELSKTKQEMLKQLSILKEAHQDELGRMSEDLEDELGARSSMDRKMAELRGEMERLQAENAAEWGRRERLETEKLGLERENKKLRAQVGDLEEALARRRRQTASALDCDLRASQAALFEKNKELADLKHVHGKLKKQFQEKVAELAHANRRVEQHEAEVKKLRLRVEELKKELAQAEDELDEAHNQARKLQRSLDEQTEQSENLQVQLEHLQSRLRRQQQNAPLFGKIRSARFGTEEAEDGTSDLDEDEDLQIQVA

SEQ ID NO: 18201 - protein, 513 aa, Homo sapiens
  Payload ID: 3633
  Gene Symbol: CCDC102B
  Gene Name: coiled-coil domain containing 102B
  Uniprot ID: Q68D86
  ENSP ID: ENSP00000316237
MNLDSIHRLIEETQIFQMQQSSIKSRGDMVAPASPPRDTCNTCFPLHGLQSHAAHNFCAHSYNTNKWDICEELRLRELEEVKARAAQMEKTMRWWSDCTANWREKWSKVRAERNSAREEGRQLRIKLEMAMKELSTLKKKQSLPPQKEALEAKVTQDLKLPGFVEESCEHTDQFQLSSQMHESIREYLVKRQFSTKEDTNNKEQGVVIDSLKLSEEMKPNLDGVDLFNNGGSGNGETKTGLRLKAINLPLENEVTEISALQVHLDEFQKILWKEREMRTALEKEIERLESALSLWKWKYEELKESKPKNVKEFDILLGQHNDEMQELSGNIKEESKSQNSKDRVICELRAELERLQAENTSEWDKREILEREKQGLERENRRLKIQVKEMEELLDKKNRLSANSQSPDFKMSQIDLQEKNQELLNLQHAYYKLNRQYQANIAELTHANNRVDQNEAEVKKLRLRVEELKQGLNQKEDELDDSLNQIRKLQRSLDEEKERNENLETELRHLQNW

SEQ ID NO: 18202 - protein, 139 aa, Homo sapiens
  Payload ID: 3633
  Gene Symbol: CCDC102B
  Gene Name: coiled-coil domain containing 102B
  ENSP ID: ENSP00000351479
MEGKRNAHSFGKRNRETGVGFVSVEVEFDILLGQHNDEMQELSGNIKEESKSQNSKDRVICELRAELERLQAENTSEWDKREILEREKQGLERENRRLKIQVKEMEELLDKKNRLSANSQSPDFKMSQIDLQEKNQDVK

SEQ ID NO: 18203 - protein, 513 aa, Homo sapiens; identical to SEQ ID NO: 18201
  Payload ID: 3633
  Gene Symbol: CCDC102B
  Gene Name: coiled-coil domain containing 102B
  Uniprot ID: Q68D86
  ENSP ID: ENSP00000353377

SEQ ID NO: 18204 - protein, 92 aa, Homo sapiens
  Payload ID: 3633
  Gene Symbol: CCDC102B
  Gene Name: coiled-coil domain containing 102B
  ENSP ID: ENSP00000461987
MNLDSIHRLIEETQIFQMQQSSIKSRGDMVAPASPPRDTCNTCFPLHGLQSHAAHNFCAHSYNTNKWDICEELRLRELEEVKARAAQMEKTM

SEQ ID NO: 18205 - protein, 137 aa, Homo sapiens
  Payload ID: 3633
  Gene Symbol: CCDC102B
  Gene Name: coiled-coil domain containing 102B
  ENSP ID: ENSP00000462150
MNLDSIHRLIEETQIFQMQQSSIKSRGDMVAPASPPRDTCNTCFPLHGLQSHAAHNFCAHSYNTNKWDICEELRLRELEEVKARAAQMEKTMRWWSDCTANWREKWSKVRAERNSAREEGRQLRIKLEMAMKELSTL

SEQ ID NO: 18206 - protein, 483 aa, Homo sapiens
  Payload ID: 3633
  Gene Symbol: CCDC102B
  Gene Name: coiled-coil domain containing 102B
  Uniprot ID: Q68D86
  ENSP ID: ENSP00000463111
MNLDSIHRLIEETQIFQMQQSSIKSRGDMVAPASPPRDTCNTCFPLHGLQSHAAHNFCAHSYNTNKWDICEELRLRELEEVKARAAQMEKTMRWWSDCTANWREKWSKVRAERNSAREEGRQLRIKLEMAMKELSTLKKKQSLPPQKEALEAKVTQDLKLPGFVEESCEHTDQFQLSSQMHESIREYLVKRQFSTKEDTNNKEQGVVIDSLKLSEEMKPNLDGVDLFNNGGSGNGETKTGLRLKAINLPLENEVTEISALQVHLDEFQKILWKEREMRTALEKEIERLESALSLWKWKYEELKESKPKNVKEFDILLGQHNDEMQELSGNIKEESKSQNSKDRVICELRAELERLQAENTSEWDKREILEREKQGLERENRRLKIQVKEMEELLDKKNRLSANSQSPDFKMSQIDLQEKNQELLNLQHAYYKLNRQYQANIAELTHANNRVDQNEAEVKKLRLRVEELKQGLNQKEDEVLLYE

SEQ ID NO: 18207 - protein, 124 aa, Homo sapiens
  Payload ID: 3633
  Gene Symbol: CCDC102B
  Gene Name: coiled-coil domain containing 102B
  ENSP ID: ENSP00000463399
MNLDSIHRLIEETQIFQMQQSSIKSRGDMVAPASPPRDTCNTCFPLHGLQSHAAHNFCAHSYNTNKWDICEELRLRELEEVKARAAQMEKTMRWWSDCTANWREKWSKVRAERNSAREEGRQLR

SEQ ID NO: 18208 - protein, 325 aa, Homo sapiens
  Payload ID: 3633
  Gene Symbol: CCDC102B
  Gene Name: coiled-coil domain containing 102B
  ENSP ID: ENSP00000463538
MNLDSIHRLIEETQIFQMQQSSIKSRGDMVAPASPPRDTCNTCFPLHGLQSHAAHNFCAHSYNTNKWDICEELRLRELEEVKARAAQMEKTMRWWSDCTANWREKWSKVRAERNSAREEGRQLRIKLEMAMKELSTLKKKQSLPPQKEALEAKVTQDLKLPGFVEESCEHTDQFQLSSQMHESIREYLVKRQFSTKEDTNNKEQGVVIDSLKLSEEMKPNLDGVDLFNNGGSGNGETKTGLRLKAINLPLENEVTEISALQVHLDEFQKILWKEREMRTALEKEIERLESALSLWKWKYEELKESKPKNVKEFDILLGQHNDEMQ

SEQ ID NO: 18209 - protein, 237 aa, Homo sapiens
  Payload ID: 3634
  Gene Symbol: CCDC103
  Gene Name: coiled-coil domain containing 103
  ENSP ID: ENSP00000350420
MERNDIINFKALEKELQAALTADEKYKRENAAKLRAVEQRVASYEEFRGIVLASHLKPLERKDKMGGKRTVPWNCHTIQGRTFQDVATEISPEKAPLQPETSADFYRDWRRHLPSGPERYQALLQLGGPRLGCLFQTDVGFGLLGELLVALADHVGPADRAAVLGILCSLASTGRFTLNLSLLSRAERESCKGLFQKLQAMGNPRSVKEGLSWEEQGLEEQSGGLQEEERLLQELLE

SEQ ID NO: 18210 - protein, 98 aa, Homo sapiens
  Payload ID: 3634
  Gene Symbol: CCDC103
  Gene Name: coiled-coil domain containing 103
  Uniprot ID: Q8IW40
  ENSP ID: ENSP00000386640
MERNDIINFKALEKELQAALTADEKYKRENAAKLRAVEQRVASYEEFRGIVLASHLKPLERKDKMGGKRTVPWNCHTIQGRTFQDVATEISPNSWKSS

SEQ ID NO: 18211 - protein, 242 aa, Homo sapiens
  Payload ID: 3634
  Gene Symbol: CCDC103
  Gene Name: coiled-coil domain containing 103
  Uniprot ID: Q8IW40
  ENSP ID: ENSP00000387252
MERNDIINFKALEKELQAALTADEKYKRENAAKLRAVEQRVASYEEFRGIVLASHLKPLERKDKMGGKRTVPWNCHTIQGRTFQDVATEISPEKAPLQPETSADFYRDWRRHLPSGPERYQALLQLGGPRLGCLFQTDVGFGLLGELLVALADHVGPADRAAVLGILCSLASTGRFTLNLSLLSRAERESCKGLFQKLQAMGNPRSVKEGLSWEEQGLEEQSGGLQEEERLLQELLELYQVD

SEQ ID NO: 18212 - protein, 242 aa, Homo sapiens; identical to SEQ ID NO: 18211
  Payload ID: 3634
  Gene Symbol: CCDC103
  Gene Name: coiled-coil domain containing 103
  Uniprot ID: Q8IW40
  ENSP ID: ENSP00000391692

SEQ ID NO: 18213 - protein, 59 aa, Homo sapiens
  Payload ID: 3634
  Gene Symbol: CCDC103
  Gene Name: coiled-coil domain containing 103
  ENSP ID: ENSP00000462450
MERNDIINFKALEKELQAALTADEKYKRENAAKLRAVEQRVASYEEFRGIVLASHLKPL

SEQ ID NO: 18214 - protein, 499 aa, Homo sapiens
  Payload ID: 3635
  Gene Symbol: CCDC105
  Gene Name: coiled-coil domain containing 105
  Uniprot ID: Q8IYK2
  ENSP ID: ENSP00000292574
MRVLVPPAERSQDTRVGAPAWREAAQAMARTAHILTDRCGQEAVTMWQPKDSVLDPNVAHHLGRAAYIQPWRFRVEMIKGGGTLEKPPPGEGVTLWKGKMKPPAWYARLPLPLHRKARALQTTEVVHAHARGARLTAARLGRAQHQINGRVRQLLRQREVTDHRLSEVRKGLLINQQSVKLRGYRPKSEKVPDKADSMLTWEKEELKSMKRKMERDMEKSEVLLKTLASCRDTLNFCFKERLQAVDLMNQPLDKVLEQARRHSWVNLSRAPTPRTQGQKTPPPDPVGTYNPACALALNEAKRLLVESKDTLVEMAKNEVDVREQQLQISDRVCASLAQKASETLELKERLNMTLGLMRGTILRCTKYNQELYTTHGLIKGPLSKVHLETAEKLDRPLVRMYQRHVGTQLPEAARLAQGTDKLQCHITYLEKNLDELLATHKNLSWGLNCKNIGHEVDGNVVRLRLRQRQPHVCYEQAQRLVKDWDPRTPPPRSKSSADP

SEQ ID NO: 18215 - protein, 280 aa, Homo sapiens
  Payload ID: 3636
  Gene Symbol: CCDC106
  Gene Name: coiled-coil domain containing 106
  Uniprot ID: Q9BWC9
  ENSP ID: ENSP00000309681
MNDRSSRRRTMKDDETFEISIPFDEAPHLDPQIFYSLSPSRRNFEEPPEAASSALALMNSVKTQLHMALERNSWLQKRIEDLEEERDFLRCQLDKFISSARMEAEDHCRMKPGPRRMEGDSRGGAGGEASDPESAASSLSGASEEGSASERRRQKQKGGASRRRFGKPKARERQRVKDADGVLCRYKKILGTFQKLKSMSRAFEHHRVDRNTVALTTPIAELLIVAPEKLAEVGEFDPSKERLLEYSRRCFLALDDETLKKVQALKKSKLLLPITYRFKR

SEQ ID NO: 18216 - protein, 280 aa, Homo sapiens; identical to SEQ ID NO: 18215
  Payload ID: 3636
  Gene Symbol: CCDC106
  Gene Name: coiled-coil domain containing 106
  Uniprot ID: Q9BWC9
  ENSP ID: ENSP00000465757

SEQ ID NO: 18217 - protein, 245 aa, Homo sapiens
  Payload ID: 3636
  Gene Symbol: CCDC106
  Gene Name: coiled-coil domain containing 106
  ENSP ID: ENSP00000466521
MNDRSSRRRTKPPEAASSALALMNSVKTQLHMALERNSWLQKRIEDLEEERDFLRCQLDKFISSARMEAEDHCRMKPGPRRMEGDSRGGAGGEASDPESAASSLSGASEEGSASERRRQKQKGGASRRRFGKPKARERQRVKDADGVLCRYKKILGTFQKLKSMSRAFEHHRVDRNTVALTTPIAELLIVAPEKLAEVGEFDPSKERLLEYSRRCFLALDDETLKKVQALKKSKLLLPITYRFKR

SEQ ID NO: 18218 - protein, 172 aa, Homo sapiens
  Payload ID: 3636
  Gene Symbol: CCDC106
  Gene Name: coiled-coil domain containing 106
  ENSP ID: ENSP00000466597
MNDRSSRRRTMKDDETFEISIPFDEAPHLDPQIFYSLSPSRRNFEEPPEAASSALALMNSVKTQLHMALERNSWLQKRIEDLEEERDFLRCQLDKFISSARMEAEDHCRMKPGPRRMEGDSRGGAGGEASDPESAASSLSGASEEGSASERRRQKQKGGASRRRFGKPKARE

SEQ ID NO: 18219 - protein, 280 aa, Homo sapiens; identical to SEQ ID NO: 18215
  Payload ID: 3636
  Gene Symbol: CCDC106
  Gene Name: coiled-coil domain containing 106
  Uniprot ID: Q9BWC9
  ENSP ID: ENSP00000466870

SEQ ID NO: 18220 - protein, 39 aa, Homo sapiens
  Payload ID: 3636
  Gene Symbol: CCDC106
  Gene Name: coiled-coil domain containing 106
  ENSP ID: ENSP00000468077
MNDRSSRRRTMKDDETFEISIPFDEAPHLDPQIFYSLSP

SEQ ID NO: 18221 - protein, 45 aa, Homo sapiens
  Payload ID: 3636
  Gene Symbol: CCDC106
  Gene Name: coiled-coil domain containing 106
  ENSP ID: ENSP00000468521
MNDRSSRRRTMKDDETFEISIPFDEAPHLDPQIFYSLSPSRRNFE

SEQ ID NO: 18222 - protein, 280 aa, Homo sapiens; identical to SEQ ID NO: 18215
  Payload ID: 3636
  Gene Symbol: CCDC106
  Gene Name: coiled-coil domain containing 106
  Uniprot ID: Q9BWC9
  ENSP ID: ENSP00000468539

SEQ ID NO: 18223 - protein, 155 aa, Homo sapiens
  Payload ID: 3637
  Gene Symbol: CCDC107
  Gene Name: coiled-coil domain containing 107
  Uniprot ID: Q8WV48
  ENSP ID: ENSP00000330327
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFERPAGASEHEAMDHPRAAAR

SEQ ID NO: 18224 - protein, 137 aa, Homo sapiens
  Payload ID: 3637
  Gene Symbol: CCDC107
  Gene Name: coiled-coil domain containing 107
  ENSP ID: ENSP00000367661
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFER

SEQ ID NO: 18225 - protein, 139 aa, Homo sapiens
  Payload ID: 3637
  Gene Symbol: CCDC107
  Gene Name: coiled-coil domain containing 107
  Uniprot ID: Q8WV48
  ENSP ID: ENSP00000367662
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFERSF

SEQ ID NO: 18226 - protein, 256 aa, Homo sapiens
  Payload ID: 3637
  Gene Symbol: CCDC107
  Gene Name: coiled-coil domain containing 107
  Uniprot ID: Q8WV48
  ENSP ID: ENSP00000367665
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFERVTTLAGAQQELLNMKLWTIHELLQDSKPDKDMEASEPEASRPLPEDFCLKEDEEEIGDSQAWEEPTNWSTETWNLATSWEVGRGLRRRCSQAVAKGPSHSLGWEGGTTAEGRLKQSLFS

SEQ ID NO: 18227 - protein, 119 aa, Homo sapiens
  Payload ID: 3637
  Gene Symbol: CCDC107
  Gene Name: coiled-coil domain containing 107
  Uniprot ID: Q8WV48
  ENSP ID: ENSP00000413003
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSGGFSRSLCWVGGV

SEQ ID NO: 18228 - protein, 283 aa, Homo sapiens
  Payload ID: 3637
  Gene Symbol: CCDC107
  Gene Name: coiled-coil domain containing 107
  Uniprot ID: Q8WV48
  ENSP ID: ENSP00000414964
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFERVTTLAGAQQELLNMKLWTIHELLQDSKPDKDMEASEPGEGSGGESAGGGDKVSETGTFLISPHTEASRPLPEDFCLKEDEEEIGDSQAWEEPTNWSTETWNLATSWEVGRGLRRRCSQAVAKGPSHSLGWEGGTTAEGRLKQSLFS

SEQ ID NO: 18229 - protein, 164 aa, Homo sapiens
  Payload ID: 3638
  Gene Symbol: CCDC108
  Gene Name: coiled-coil domain containing 108
  Uniprot ID: Q6ZU64
  ENSP ID: ENSP00000295729
MMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRYQYKGSRTQCHSLEPRKQALFKTKQNKQKKPLTCHIKASECLKYVQYE

SEQ ID NO: 18230 - protein, 1925 aa, Homo sapiens
  Payload ID: 3638
  Gene Symbol: CCDC108
  Gene Name: coiled-coil domain containing 108
  Uniprot ID: Q6ZU64
  ENSP ID: ENSP00000340776
MFTLTGCRLVEKTQKVENPSVSFASSFPLIPLLLRGKSVQKKQAESKSQIKLHTQSAPFGLCPKDMMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAKEYMDQLWFEKAEGMFCVGLRATLPCHRLICRPPSLQLPMCAVGDTTEAFFCLDNVGDLPTFFTWEFSSPFQMLPATGLLEPGQASQIKVTFQPLTAVIYEVQATCWYGAGSRQRSSIQLQAVAKCAQLLVSIKHKCPEDQDAEGFQKLLYFGSVAVGCTSERQIRLHNPSAVNAPFRIEISPDELAEDQAFSCPTAHGIVLPGEKKCVSVFFHPKTLDTRTVDYCSIMPSGCASKTLLKVVGFCRGPAVSLQHYCVNFSWVNLGERSEQPLWIENQSDCTAHFQFAIDCLESVFTIRPAFGTLVGKARMTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVLQSYSNIEEDCTMCPSWCLTVRARGHSYFAGFEHHIPQYSLDVPKLFPAVSSGEPTYRSLLLVNKDCKLLTFSLAPQRGSDVILRPTSGLVAPGAHQIILICTYPEGSSWKQHTFYLQCNASPQYLKEVSMYSREEPLQLKLDTHKSLYFKPTWVGCSSTSPFTFRNPSRLPLQFEWRVSEQHRKLLAVQPSRGLIQPNERLTLTWTFSPLEETKYLFQVGMWVWEAGLSPNANPAATTHYMLRLVGVGLTSSLSAKEKELAFGNVLVNSKQSRFLVLLNDGNCTLYYRLYLEQGSPEAVDNHPLALQLDRTEGSMPPRSQDTICLTACPKQRSQYSWTITYSLLSHRDNKAGEKQELCCVSLVAVYPLLSILDVSSMGSAEGITRKHLWRLFSLDLLNSYLERDPTPCELTYKVPTRHSMSQIPPVLTPLRLDFNFGAAPFKAPPSVVFLALKNSGVVSLDWAFLLPSDQRIDVELWAEQAELNSTELHQMRVQDNCLFSISPKAGSLSPGQEQMVELKYSHLFIGTDHLPVLFKVSHGREILLNFIGVTVKPEQKYVHFTSTTHQFIPIPIGDTLPPRQIYELYNGGSVPVTYEVQTDVLSQVQEKNFDHPIFCCLNPKGEIQPGSTARVLWIFSPIEAKTYTVDVPIHILGWNSALIHFQGVGYNPHMMGDTAPFHNISSWDNSSIHSRLVVPGQNVFLSQSHISLGNIPVQSKCSRLLFLNNISKNEEIAFSWQPSPLDFGEVSVSPMIGVVAPEETVPFVVTLRASVHASFYSADLVCKLYSQQLMRQYHKELQEWKDEKVRQEVEFTITDMKVKKRTCCTACEPARKYKTLPPIKNQQSVSRPASWKLQTPKEEVSWPCPQPPSPGMLCLGLTARAHATDYFLANFFSEFPCHFLHRELPKRKAPREESETSEEKSPNKWGPVSKQKKQLLVDILTTIIRGLLEDKNFHEAVDQSLVEQVPYFRQFWNEQSTKFMDQKNSLYLMPILPVPSSSWEDGKGKQPKEDRPEHYPGLGKKEEGEEEKGEEEEEELEEEEEEEEETEEEELGKEEIEEKEEERDEKEEKVSWAGIGPTPQPESQESMQWQWQQQLNVMVKEEQEQDEKEAIRRLPAFANLQEALLENMIQNILVEASRGEVVLTSRPRVIALPPFCVPRSLTPDTLLPTQQAEVLHPVVPLPTDLP

SEQ ID NO: 18231 - protein, 730 aa, Homo sapiens
  Payload ID: 3638
  Gene Symbol: CCDC108
  Gene Name: coiled-coil domain containing 108
  Uniprot ID: Q6ZU64
  ENSP ID: ENSP00000386258
MMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAKEYMDQLWFEKAEGMFCVGLRATLPCHRLICRPPSLQLPMCAVGDTTEAFFCLDNVGDLPTFFTWEFSSPFQMLPATGLLEPGQASQIKVTFQPLTAVIYEVQATCWYGAGSRQRSSIQLQAVAKCAQLLVSIKHKCPEDQDAEGFQKLLYFGSVAVGCTSERQIRLHNPSAVNAPFRIEISPDELAEDQAFSCPTAHGIVLPGEKKCVSVFFHPKTLDTRTVDYCSIMPSGCASKTLLKVVGFCRGPAVSLQHYCVNFSWVNLGERSEQPLWIENQSDCTAHFQFAIDCLESVFTIRPAFGTLVGKARMTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVCARNEREECGVSARSLSGLVGWQEVTEGSFRLHPLRARLSLGWTVTPMSLSPPKLLA

SEQ ID NO: 18232 - protein, 784 aa, Homo sapiens
  Payload ID: 3638
  Gene Symbol: CCDC108
  Gene Name: coiled-coil domain containing 108
  Uniprot ID: Q6ZU64
  ENSP ID: ENSP00000386945
METAIWRRSYISLISSERPVHNWRGKSVQKKQAESKSQIKLHTQSAPFGLCPKDMMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAKEYMDQLWFEKAEGMFCVGLRATLPCHRLICRPPSLQLPMCAVGDTTEAFFCLDNVGDLPTFFTWEFSSPFQMLPATGLLEPGQASQIKVTFQPLTAVIYEVQATCWYGAGSRQRSSIQLQAVAKCAQLLVSIKHKCPEDQDAEGFQKLLYFGSVAVGCTSERQIRLHNPSAVNAPFRIEISPDELAEDQAFSCPTAHGIVLPGEKKCVSVFFHPKTLDTRTVDYCSIMPSGCASKTLLKVVGFCRGPAVSLQHYCVNFSWVNLGERSEQPLWIENQSDCTAHFQFAIDCLESVFTIRPAFGTLVGKARMTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVCARNEREECGVSARSLSGLVGWQEVTEGSFRLHPLRARLSLGWTVTPMSLSPPKLLA

SEQ ID NO: 18233 - protein, 234 aa, Homo sapiens
  Payload ID: 3638
  Gene Symbol: CCDC108
  Gene Name: coiled-coil domain containing 108
  ENSP ID: ENSP00000393483
METAIWRRSYISLISSERPVHNWRGKSVQKKQAESKSQIKLHTQSAPFGLCPKDMMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAPLTAVIYEVQATCWYGAGSRQRSSIQLQAV

SEQ ID NO: 18234 - protein, 127 aa, Homo sapiens
  Payload ID: 3638
  Gene Symbol: CCDC108
  Gene Name: coiled-coil domain containing 108
  ENSP ID: ENSP00000394019
  MOD_RES (1)..(1): Any amino acid
XKQELCCVSLVAVYPLLSILDVSSMGSAEGITRKHLWRLFSLDLLNSYLERDPTPCELTYKVPTRHSMSQIPPVLTPLRLDFNFGAAPFKAPPSVVFLALKNSGVVSLDWYGLKGATGGPGRQVPRG

SEQ ID NO: 18235 - protein, 117 aa, Homo sapiens
  Payload ID: 3638
  Gene Symbol: CCDC108
  Gene Name: coiled-coil domain containing 108
  ENSP ID: ENSP00000396836
MMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRP

SEQ ID NO: 18236 - protein, 1925 aa, Homo sapiens; identical to SEQ ID NO: 18230
  Payload ID: 3638
  Gene Symbol: CCDC108
  Gene Name: coiled-coil domain containing 108
  Uniprot ID: Q6ZU64
  ENSP ID: ENSP00000409117

SEQ ID NO: 18237 - protein, 271 aa, Homo sapiens
  Payload ID: 3638
  Gene Symbol: CCDC108
  Gene Name: coiled-coil domain containing 108
  ENSP ID: ENSP00000413377
MTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVCARNEREECGVSARSLSGLVGWQEVTEGSFRLHPLRARLSLGWTVTPMSLSPPKLLA

SEQ ID NO: 18238 - protein, 114 aa, Homo sapiens
  Payload ID: 3638
  Gene Symbol: CCDC108
  Gene Name: coiled-coil domain containing 108
  ENSP ID: ENSP00000413746
MMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMK

SEQ ID NO: 18239 - protein, 336 aa, Homo sapiens
  Payload ID: 3639
  Gene Symbol: CCDC109B
  Gene Name: coiled-coil domain containing 109B
  Uniprot ID: Q9NWR8
  ENSP ID: ENSP00000378145
MLQRGLWPWRTRLLPTPGTWRPARPWPLPPPPQVLRVKLCGNVKYYQSHHYSTVVPPDEITVIYRHGLPLVTLTLPSRKERCQFVVKPMLSTVGSFLQDLQNEDKGIKTAAIFTADGNMISASTLMDILLMNDFKLVINKIAYDVQCPKREKPSNEHTAEMEHMKSLVHRLFTILHLEESQKKREHHLLEKIDHLKEQLQPLEQVKAGIEAHSEAKTSGLLWAGLALLSIQGGALAWLTWWVYSWDIMEPVTYFITFANSMVFFAYFIVTRQDYTYSAVKSRQFLQFFHKKSKQQHFDVQQYNKLKEDLAKAKESLKQARHSLCLQMQVEELNEKN

SEQ ID NO: 18240 - protein, 833 aa, Homo sapiens
  Payload ID: 3640
  Gene Symbol: CCDC110
  Gene Name: coiled-coil domain containing 110
  Uniprot ID: Q8TBZ0
  ENSP ID: ENSP00000306776
MSPEKQHREEDEVDSVLLSASKILNSSEGVKESGCSDTEYGCIAESENQIQPQSALKVLQQQLESFQALRMQTLQNVSMVQSEISEILNKSIIEVENPQFSSEKNLVFGTRIEKDLPTENQEENLSMEKSHHFEDSKTLHSVEEKLSGDSVNSLPQSVNVPSQIHSEDTLTLRTSTDNLSSNIIIHPSENSDILKNYNNFYRFLPTAPPNVMSQADTVILDKSKITVPFLKHGFCENLDDICHSIKQMKEELQKSHDGEVALTNELQTLQTDPDVHRNGKYDMSPIHQDKMNFIKEENLDGNLNEDIKSKRISELEALVKKLLPFRETVSKFHVHFCRKCKKLSKSEMHRGKKNEKNNKEIPITGKNITDLKFHSRVPRYTLSFLDQTKHEMKDKERQPFLVKQGSIISENEKTSKVNSVTEQCVAKIQYLQNYLKESVQIQKKVMELESENLNLKSKMKPLIFTTQSLIQKVETYEKQLKNLVEEKSTIQSKLSKTEEYSKECLKEFKKIISKYNVLQGQNKTLEEKNIQLSLEKQQMMEALDQLKSKEHKTQSDMAIVNNENNRMSIEMEAMKTNILLIQDEKEMLEKKTHQLLKEKSSLGNELKESQLEIIQLKEKERLAKTEQETLLQIIETVKDEKLNLETTLQESTAARQIMEREIENIQTYQSTAEENFLQEIKNAKSEASIYKNSLSEIGKECEMLSKMVMETKTDNQILKEELKKHSQENIKFENSISRLTEDKILLENYVRSIENERDTLEFEMRHLQREYLSLSDKICNQHNDPSKTTYISRREKFHFDNYTHEDTSSPQSRPLASDLKGYFKVKDRTLKHH

SEQ ID NO: 18241 - protein, 796 aa, Homo sapiens
  Payload ID: 3640
  Gene Symbol: CCDC110
  Gene Name: coiled-coil domain containing 110
  Uniprot ID: Q8TBZ0
  ENSP ID: ENSP00000377172
MSPEKQHREEDEVDSVLLSASKILNSSEGVKESGCSDTEYGCIAESENQIQPQSALKVLQQQLESFQALRMQTLQNVSMPTENQEENLSMEKSHHFEDSKTLHSVEEKLSGDSVNSLPQSVNVPSQIHSEDTLTLRTSTDNLSSNIIIHPSENSDILKNYNNFYRFLPTAPPNVMSQADTVILDKSKITVPFLKHGFCENLDDICHSIKQMKEELQKSHDGEVALTNELQTLQTDPDVHRNGKYDMSPIHQDKMNFIKEENLDGNLNEDIKSKRISELEALVKKLLPFRETVSKFHVHFCRKCKKLSKSEMHRGKKNEKNNKEIPITGKNITDLKFHSRVPRYTLSFLDQTKHEMKDKERQPFLVKQGSIISENEKTSKVNSVTEQCVAKIQYLQNYLKESVQIQKKVMELESENLNLKSKMKPLIFTTQSLIQKVETYEKQLKNLVEEKSTIQSKLSKTEEYSKECLKEFKKIISKYNVLQGQNKTLEEKNIQLSLEKQQMMEALDQLKSKEHKTQSDMAIVNNENNRMSIEMEAMKTNILLIQDEKEMLEKKTHQLLKEKSSLGNELKESQLEIIQLKEKERLAKTEQETLLQIIETVKDEKLNLETTLQESTAARQIMEREIENIQTYQSTAEENFLQEIKNAKSEASIYKNSLSEIGKECEMLSKMVMETKTDNQILKEELKKHSQENIKFENSISRLTEDKILLENYVRSIENERDTLEFEMRHLQREYLSLSDKICNQHNDPSKTTYISRREKFHFDNYTHEDTSSPQSRPLASDLKGYFKVKDRTLKHH

SEQ ID NO: 18242 - protein, 66 aa, Homo sapiens
  Payload ID: 3640
  Gene Symbol: CCDC110
  Gene Name: coiled-coil domain containing 110
  ENSP ID: ENSP00000424520
MSPEKQHREEDEVDSVLLSASKILNSSEGVKESGCSDTGPSAAVGIISGFANADFAECQHGTVGNQ

SEQ ID NO: 18243 - protein, 124 aa, Homo sapiens
  Payload ID: 3640
  Gene Symbol: CCDC110
  Gene Name: coiled-coil domain containing 110
  ENSP ID: ENSP00000424878
EDKILLENYVRSIENERDTLEFEMRHLQREYLSLSDKICNQHNDPSKTTYISRREKFHFDNYTHEDTSSPQSRPLASDLKGGNNTHACPGSRGNTISSFQGCKHTCSVLQRHSVFQDCYSNIPC

SEQ ID NO: 18244 - protein, 257 aa, Homo sapiens
  Payload ID: 3640
  Gene Symbol: CCDC110
  Gene Name: coiled-coil domain containing 110
  ENSP ID: ENSP00000425276
MSPEKQHREEDEVDSVLLSASKILNSSEGVKESGCSDTEYGCIAESENQIQPQSALKVLQQQLESFQALRMQTLQNVSMVQSEISEILNKSIIEVENPQFSSEKNLVFGTRIEKDLEKWTIRDENKETPVLKTLKDPTENQEENLSMEKSHHFEDSKTLHSVEEKLSGDSVNSLPQSVNVPSQIHSEDTLTLRTSTDNLSSNIIIHPSENSDILKNYNNFYRFLPTAPPNVMSQADTVILDKSKITVPFLKHGFCEN

SEQ ID NO: 18245 - protein, 49 aa, Homo sapiens
  Payload ID: 3640
  Gene Symbol: CCDC110
  Gene Name: coiled-coil domain containing 110
  ENSP ID: ENSP00000425547
MSPEKQHREEDEVDSVLLSASKILNSSEGVKESGCSDTDKETGTERLTP

SEQ ID NO: 18246 - protein, 836 aa, Homo sapiens
  Payload ID: 3640
  Gene Symbol: CCDC110
  Gene Name: coiled-coil domain containing 110
  ENSP ID: ENSP00000427246
MSPEKQHREEDEVDSVLLSASKILNSSEGVKESGCSDTEYGCIAESENQIQPQSALKVLQQQLESFQALRMQTLQNVSMVQSEISEILNKSIIEVENPQFSSEKNLVFGTRIEKDLPTENQEENLSMEKSHHFEDSKTLHSVEEKLSGDSVNSLPQSVNVPSQIHSEDTLTLRTSTDNLSSNIIIHPSENSDILKNYNNFYRFLPTAPPNVMSQADTVILDKSKITVPFLKHGFCENLDDICHSIKQMKEELQKSHDGEVALTNELQTLQTDPDVHRNGKYDMSPIHQDKMNFIKEENLDGNLNEDIKSKRISELEALVKKLLPFRETVSKFHVHFCRKCKKLSKSEMHRGKKNEKNNKEIPITGKNITDLKFHSRVPRYTLSFLDQTKHEMKDKERQPFLVKQGSIISENEKTSKVNSVTEQCVAKIQYLQNYLKESVQIQKKVMELESENLNLKSKMKPLIFTTQSLIQKVETYEKQLKNLVEEKSTIQSKLSKTEEYSKECLKEFKKIISKYNVLQGQNKTLEEKNIQLSLEKQQMMEALDQLKSKEHKTQSDMAIVNNENNRMSIEMEAMKTNILLIQDEKEMLEKKTHQLLKEKSSLGNELKESQLEIIQLKEKERLAKTEQETLLQIIETVKDEKLNLETTLQESTAARQIMEREIENIQTYQSTAEENFLQEIKNAKSEASIYKNSLSEIGKECEMLSKMVMETKTDNQILKEELKKHSQENIKFENSISRLTEDKILLENYVRSIENERDTLEFEMRHLQREYLSLSDKICNQHNDPSKTTYISRREKFHFDNYTHEDTSSPQSRPLASDLKGIPSKLYHLLPSKIYK

SEQ ID NO: 18247 - protein, 115 aa, Homo sapiens
  Payload ID: 3640
  Gene Symbol: CCDC110
  Gene Name: coiled-coil domain containing 110
  ENSP ID: ENSP00000485145
MQTLQNVSMVQSEISEILNKSIIEVENPQFSSEKNLVFGTRIEKDLPTENQEENLSMEKSHHFEDSKTLHSVEEKLSGDSVNSLPQSVNVPSQIHSEDTLTLRTSTDNLSSNIII

SEQ ID NO: 18248 - protein, 150 aa, Homo sapiens
  Payload ID: 3640
  Gene Symbol: CCDC110
  Gene Name: coiled-coil domain containing 110
  ENSP ID: ENSP00000485309
MQTLQNVSMVQSEISEILNKSIIEVENPQFSSEKNLVFGTRIEKDLPTENQEENLSMEKSHHFEDSKTLHSVEEKLSGDSVNSLPQSVNVPSQIHSEDTLTLRTSTDNLSSNIIIHPSENSDILKNYNNFYRFLPTAPPNVMSQADTVIL

SEQ ID NO: 18249 - protein, 529 aa, Homo sapiens
  Payload ID: 3641
  Gene Symbol: CCDC112
  Gene Name: coiled-coil domain containing 112
  Uniprot ID: Q8NEF3
  ENSP ID: ENSP00000368931
MAALTTVVVAAAATAVAGAVAGAGAATGTGVGATPAPQQSDGCFSTSGGIRPFHLQNWKQKVNQTKKAEFVRTAEKFKNQVINMEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERDLHKLELKILDRQAKEDEKSQKQRRLAKLKEKVENNVSRDPSRLYKPTKGWEERTKKIGPTGSGPLLHIPHRAIPTWRQGIQRRV

SEQ ID NO: 18250 - protein, 446 aa, Homo sapiens
  Payload ID: 3641
  Gene Symbol: CCDC112
  Gene Name: coiled-coil domain containing 112
  Uniprot ID: Q8NEF3
  ENSP ID: ENSP00000378925
MEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERDLHKLELKILDRQAKEDEKSQKQRRLAKLKEKVENNVSRDPSRLYKPTKGWEERTKKIGPTGSGPLLHIPHRAIPTWRQGIQRRV

SEQ ID NO: 18251 - protein, 446 aa, Homo sapiens; identical to SEQ ID NO: 18250
  Payload ID: 3641
  Gene Symbol: CCDC112
  Gene Name: coiled-coil domain containing 112
  Uniprot ID: Q8NEF3
  ENSP ID: ENSP00000423712

SEQ ID NO: 18252 - protein, 414 aa, Homo sapiens
  Payload ID: 3641
  Gene Symbol: CCDC112
  Gene Name: coiled-coil domain containing 112
  ENSP ID: ENSP00000424876
MEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERVENNVSRDPSRLYKPTKGWEERTKKIGPTGSGPLLHIPHRAIPTWRQGIQRRV

SEQ ID NO: 18253 - protein, 377 aa, Homo sapiens
  Payload ID: 3642
  Gene Symbol: CCDC113
  Gene Name: coiled-coil domain containing 113
  Uniprot ID: Q9H0I3
  ENSP ID: ENSP00000219299
MTDDESESVLSDSHEGSELELPVIQLCGLVEELSYVNSALKTETEMFEKYYAKLEPRDQRPPRLSEIKISAADYAQFRGRRRSKSRTGMDRGVGLTADQKLELVQKEVADMKDDLRHTRANAERDLQHHEAIIEEAEIRWSEVSREVHEFEKDILKAISKKKGSILATQKVMKYIEDMNRRRDNMKEKLRLKNVSLKVQRKKMLLQLRQKEEVSEALHDVDFQQLKIENAQFLETIEARNQELTQLKLSSGNTLQVLNAYKSKLHKAMEIYLNLDKEILLRKELLEKIEKETLQVEEDRAKAEAVNKRLRKQLAEFRAPQVMTYVREKILNADLEKSIRMWERKVEIAEMSLKGHRKAWNRMKITNEQLQADYLAGK

SEQ ID NO: 18254 - protein, 323 aa, Homo sapiens
  Payload ID: 3642
  Gene Symbol: CCDC113
  Gene Name: coiled-coil domain containing 113
  Uniprot ID: Q9H0I3
  ENSP ID: ENSP00000402588
MTDDESESVLSDSHEGSELELPVIQLCGLVEELSYVNSALKTETEMFEKYYAKLEPRDQRPPRLSEIKISAADYAQAIIEEAEIRWSEVSREVHEFEKDILKAISKKKGSILATQKVMKYIEDMNRRRDNMKEKLRLKNVSLKVQRKKMLLQLRQKEEVSEALHDVDFQQLKIENAQFLETIEARNQELTQLKLSSGNTLQVLNAYKSKLHKAMEIYLNLDKEILLRKELLEKIEKETLQVEEDRAKAEAVNKRLRKQLAEFRAPQVMTYVREKILNADLEKSIRMWERKVEIAEMSLKGHRKAWNRMKITNEQLQADYLAGK

SEQ ID NO: 18255 - protein, 58 aa, Homo sapiens
  Payload ID: 3642
  Gene Symbol: CCDC113
  Gene Name: coiled-coil domain containing 113
  ENSP ID: ENSP00000454618
MTDDESESVLSDSHEGSELELPVIQLCGLVEELRRSLRRLKFDGVKFREKCMSLKKIF

SEQ ID NO: 18256 - protein, 64 aa, Homo sapiens
  Payload ID: 3642
  Gene Symbol: CCDC113
  Gene Name: coiled-coil domain containing 113
  ENSP ID: ENSP00000455923
MFEKYYAKLEPRDQRPPRLSEIKISAADYAQFRGRRRSKSRTGMDRGVGLTADQKLELVQKEVA

SEQ ID NO: 18257 - protein, 190 aa, Homo sapiens [sequence omitted]

SEQ ID NO: 18258 - protein, 670 aa, Homo sapiens
  Payload ID: 3643
  Gene Symbol: CCDC114
  Gene Name: coiled-coil domain containing 114
  Uniprot ID: Q96M63
  ENSP ID: ENSP00000318429
MEGERRAYSKEVHQRINKQLEEIRRLEEVRGDLQVQISAAQNQVKRLRDSQRLENMDRLLKGRAQVQAEIEELQEQTRALDKQIQEWETRIFTHSKNVRSPGFILDQKVKIRRRIRILENQLDRVTCHFDNQLVRNAALREELDLLRIDRNRYLNVDRKLKKEIHHLHHLVSTLILSSTSAYAVREEAKAKMGLLRERAEKEEAQSEMEAQVLQRQILHLEQLHHFLKLKNNDRQPDPDVLEKREKQAGEVAEGVWKTSQERLVLCYEDALNKLSQLMGESDPDLLVQKYLEIEERNFAEFNFINEQNLELEHVQEEIKEMQEALVSARASKDDQHLLQEQQQKVLQQRMDKVHSEAERLEARFQDVRGQLEKLKADIQLLFTKAHCDSSMIDDLLGVKTSMGDRDMGLFLSLIEKRLVELLTVQAFLHAQSFTSLADAALLVLGQSLEDLPKKMAPLQPPDTLEDPPGFEASDDYPMSREELLSQVEKLVELQEQAEAQRQKDLAAAAAKLDGTLSVDLASTQRAGSSTVLVPTRHPHAIPGSILSHKTSRDRGSLGHVTFGGLSSSTGHLPSHITHGDPNTGHVTFGSTSASSGGHVTFRPVSASSYLGSTGYVGSSRGGENTEGGVESGGTASDSSGGLGSSRDHVSSTGPASSTGPGSSTSKDSRG

SEQ ID NO: 18259 - protein, 180 aa, Homo sapiens
  Payload ID: 3644
  Gene Symbol: CCDC115
  Gene Name: coiled-coil domain containing 115
  Uniprot ID: Q96NT0
  ENSP ID: ENSP00000259229
MAALDLRAELDSLVLQLLGDLEELEGKRTVLNARVEEGWLSLAKARYAMGAKSVGPLQYASHMEPQVCLHASEAQEGLQKFKVVRAGVHAPEEVGPREAGLRRRKGPTKTPEPESSEAPQDPLNWFGILVPHSLRQAQASFRDGLQLAADIASLQNRIDWGRSQLRGLQEKLKQLEPGAA

SEQ ID NO: 18260 - protein, 175 aa, Homo sapiens
  Payload ID: 3644
  Gene Symbol: CCDC115
  Gene Name: coiled-coil domain containing 115
  ENSP ID: ENSP00000387301
MGTPLDGGSRVPIGCPAKLRRVTRKKVAPDLEGWLSLAKARYAMGAKSVGPLQYASHMEPQVCLHASEAQEGLQKFKVVRAGVHAPEEVGPREAGLRRRKGPTKTPEPESSEAPQDPLNWFGILVPHSLRQAQASFRDGLQLAADIASLQNRIDWGRSQLRGLQEKLKQLEPGAA

SEQ ID NO: 18261 - protein, 193 aa, Homo sapiens
  Payload ID: 3644
  Gene Symbol: CCDC115
  Gene Name: coiled-coil domain containing 115
  ENSP ID: ENSP00000403480
MAALDLRAELDSLVLQLLGDLEELEGKRTVLNARVEEGWLSLAKARYAMGAKSVGPLQYASHMEPQVCLHASEAQEGLQKFKVVRAGVHAPEEVGPREAGLRRRKGPTKTPEPESSEAPQDPLNWFGILVPHSLRQAQASFRDGVLEAKKRKCFLERVIQCVVSPAAEQEAEDESCPEDWAAAVPAETSAKAI

SEQ ID NO: 18262 - protein, 613 aa, Homo sapiens
  Payload ID: 3645
  Gene Symbol: CCDC116
  Gene Name: coiled-coil domain containing 116
  Uniprot ID: Q8IYX3
  ENSP ID: ENSP00000292779
MARCRHHSGYLADDEASHSMCSARVQLPKKPLVPEMRPACKPGRVPHPPSTCGSSALQGQRRNKRHPQPFGHFLDFLTESQVLDSLETVVEKATERMAAMKTEAGVPLVEVQDPVEVPSGGRRAHARPSLSTVHRHRVRPTLCTGHPNNYPSSSSSMSNCHSSLMAGCLGSHSRDSDLGAQGSLPPVRDKLLLEKNLKRLLQLEREGKGLSQSCSQRDSLLWDSLGSQTSFQWTQEQPLSWFSGLLGSSSGVPEASEPRPGEQEPIFRKREFNKEIKSLLSQLESLDLPGYCPLREPHRTLNFLADHRLFPALQSVVSQAVDKLRGAHCRDGRPLFPTSLEPTSDLPPLGSEPAKPTNGGQPYASPRPTVSSPKMLQRKRKDRGGSPSMSSAQVATRFKLKSPCSSSRFTKKKPLPSISSKSSMSHFSNRLYEELADFLTQQAASLVIRKYEFEKDLSKQLGFFSFPITHVLRDLSLGLKKVKGSRIHLSSETHRSCLLRKLEESKRARQASRLSTSHCSTETPSVQQEPATHTAQDQATEPCRSLYTNLPASRQLSPLEPKLYMSACTGMGSSPPKSKDMDNEGRDKAEIEDEDEDEFKDEDQDEDKDEDGV

SEQ ID NO: 18263 - protein, 152 aa, Homo sapiens
  Payload ID: 3645
  Gene Symbol: CCDC116
  Gene Name: coiled-coil domain containing 116
  ENSP ID: ENSP00000401637
MGAMEQRKGWMHEGGGVRGARDPQTPGPQMRGPIGDPQVVSPPHAERNAQLKREVGSRPGHLPGDHMARCRHHSGYLADDEASHSMCSARVQLPKKPLVPEMRPACKPGRVPHPPSTCGSSALQGQRRNKRHPQPFGHFLDFLTESQVLDSL

SEQ ID NO: 18264 - protein, 526 aa, Homo sapiens
  Payload ID: 3645
  Gene Symbol: CCDC116
  Gene Name: coiled-coil domain containing 116
  Uniprot ID: Q8IYX3
  ENSP ID: ENSP00000476296
MARCRHHSGYLADDEASHSMCSARVQLPKKPLVPEMRPACKPGRVPHPPSTCGSSALQGQRRNKRHPQPFGHFLDFLTESQVLDSLETVVEKATERMAAMKTEAGVPLVEVQDPVEVPSGGRRAHARPSLSTVHRHRVRPTLCTGHPNNYPSSSSSMSNCHSSLMAGCLGSHSRDSDLGAQGSLPPVRDKLLLEKNLKRLLQLEREGKGLSQSCSQRDSLLWDSLGSQTSFQWTQEQPLSWFSGLLGSSSGVPEASEPRPGEQEPIFRKREFNKEIKSLLSQLESLDLPGYCPLREPHRTLNFLADHRLFPALQSVVSQAVDKLRGAHCRDGRPLFPTSLEPTSDLPPLGSEPAKPTNGGQPYASPRPTVSSPKMLQRKRKDRGGSPSMSSAQVATRFKLKVTPTEKPNVPSPSLHSREEAPDSDPKLQNPPVSLSSSQRAQPWQGLHLTLPTPGIVVEVACSQGHLRGPVTPPLSSPYPRSSCYLLPELSPVASSSPASLCPEVTSSKVGPGMSLQEKGSLTHHS

SEQ ID NO: 18265 - protein, 279 aa, Homo sapiens
  Payload ID: 3646
  Gene Symbol: CCDC117
  Gene Name: coiled-coil domain containing 117
  Uniprot ID: Q8IWD4
  ENSP ID: ENSP00000249064
MAALGRPFSGLPLSGGSDFLQPPQPAFPGRAFPPGADGAELAPRPGPRAVPSSPAGSAARGRVSVHCKKKHKREEEEDDDCPVRKKRITEAELCAGPNDWILCAHQDVEGHGVNPSVSGLSIPGILDVICEEMDQTTGEPQCEVARRKLQEIEDRIIDEDEEVEADRNVNHLPSLVLSDTMKTGLKREFDEVFTKKMIESMSRPSMELVLWKPLPELLSDKPKPSSNTKNYTGESQAKHVAAGTAFPQRTELFSEPRPTGMSLYNSLETATSTEEEMEL

SEQ ID NO: 18266 - protein, 204 aa, Homo sapiens
  Payload ID: 3646
  Gene Symbol: CCDC117
  Gene Name: coiled-coil domain containing 117
  Uniprot ID: Q8IWD4
  ENSP ID: ENSP00000387827
MAALGRPFSGLPLSGGSDFLQPPQPAFPGRAFPPGADGAELAPRPGPRAVPSSPAGSAARGRVSVHCKKKHKREEEEDDEIIDEDEEVEADRNVNHLPSLVLSDTMKTGLKREFDEVFTKKMIESMSRPSMELVLWKPLPELLSDKPKPSSNTKNYTGESQAKHVAAGTAFPQRTELFSEPRPTGMSLYNSLETATSTEEEMEL

SEQ ID NO: 18267 - protein, 261 aa, Homo sapiens
  Payload ID: 3646
  Gene Symbol: CCDC117
  Gene Name: coiled-coil domain containing 117
  Uniprot ID: Q8IWD4
  ENSP ID: ENSP00000389478
MAALGRPFSGLPLSGGSDFLQPPQPAFPGRAFPPGADGAELAPRPGPRAVPSSPAGSAARGRCPVRKKRITEAELCAGPNDWILCAHQDVEGHGVNPSVSGLSIPGILDVICEEMDQTTGEPQCEVARRKLQEIEDRIIDEDEEVEADRNVNHLPSLVLSDTMKTGLKREFDEVFTKKMIESMSRPSMELVLWKPLPELLSDKPKPSSNTKNYTGESQAKHVAAGTAFPQRTELFSEPRPTGMSLYNSLETATSTEEEMEL

SEQ ID NO: 18268 - protein, 113 aa, Homo sapiens
  Payload ID: 3646
  Gene Symbol: CCDC117
  Gene Name: coiled-coil domain containing 117
  ENSP ID: ENSP00000399536
MAALGRPFSGLPLSGGSDFLQPPQPAFPGRAFPPGADGAELAPRPGPRAVPSSPAGSAARGRCPVRKKRITEAELCAGPNDWILCAHQDVEGHGVNPSVSGLSIPGILDVICE

SEQ ID NO: 18269 - protein, 62 aa, Homo sapiens
  Payload ID: 3646
  Gene Symbol: CCDC117
  Gene Name: coiled-coil domain containing 117
  ENSP ID: ENSP00000411668
MAALGRPFSGLPLSGGSDFLQPPQPAFPGRAFPPGADGAELAPRPGPRAVPSSPAGSAARGR

SEQ ID NO: 18270 - protein, 70 aa, Homo sapiens
  Payload ID: 3646
  Gene Symbol: CCDC117
  Gene Name: coiled-coil domain containing 117
  ENSP ID: ENSP00000415728
MDQTTGEPQCEVARRKLQEIEDRIIDEDEEVEADRNVNHLPSLVLSDTMKTGLKREFDEVFTKKMIESMS

SEQ ID NO: 18271 - protein, 179 aa, Homo sapiens
  Payload ID: 3647
  Gene Symbol: CCDC12
  Gene Name: coiled-coil domain containing 12
  ENSP ID: ENSP00000292314
MQDGRKGGAYAGKMEATTAGVGRLEEEALRRKERLKALREKTGRKDKEDGEPKTKHLREEEEEGEKHRELRLRNYVPEDEDLKKRRVPQAKPVAVEEKVKEQLEAAKPEPVIEEVDLANLAPRKPDWDLKRDVAKKLEKLKKRTQRAIAELIRERLKGQEDSLASAVDAATEQKTCDSD

SEQ ID NO: 18272 - protein, 89 aa, Homo sapiens
  Payload ID: 3647
  Gene Symbol: CCDC12
  Gene Name: coiled-coil domain containing 12
  ENSP ID: ENSP00000387490
MEATTAGVGRLEEEALRRKERLKALREKTGRKDKEDGEPKTKHLREEEEEGEKHRELRLRNYVPEDEDLKKRRVPQAKPVAVEEKVKEQ

SEQ ID NO: 18273 - protein, 166 aa, Homo sapiens
  Payload ID: 3647
  Gene Symbol: CCDC12
  Gene Name: coiled-coil domain containing 12
  Uniprot ID: Q8WUD4
  ENSP ID: ENSP00000416263
MEATTAGVGRLEEEALRRKERLKALREKTGRKDKEDGEPKTKHLREEEEEGEKHRELRLRNYVPEDEDLKKRRVPQAKPVAVEEKVKEQLEAAKPEPVIEEVDLANLAPRKPDWDLKRDVAKKLEKLKKRTQRAIAELIRERLKGQEDSLASAVDAATEQKTCDSD

SEQ ID NO: 18274 - protein, 81 aa, Homo sapiens
  Payload ID: 3647
  Gene Symbol: CCDC12
  Gene Name: coiled-coil domain containing 12
  ENSP ID: ENSP00000473887
MEATTAGVGRLEEEALRRKERLKALREKTGRKDKEDGEPKTKHLREEEEEGEKHRELRLRNYVPEDEDLKKRRVPQAKPVA

SEQ ID NO: 18275 - protein, 618 aa, Homo sapiens
  Payload ID: 3648
  Gene Symbol: CCDC120
  Gene Name: coiled-coil domain containing 120
  Uniprot ID: Q96HB5
  ENSP ID: ENSP00000443351
MEVKAALFGEAAPQVKSERLRGLLDRQRTLQEALSLKLQELRKVCLQEAELTGQLPPECPLEPGERPQLVRRRPPTARAYPPPHPNQAHHSLCPAEELALEALEREVSVQQQIAAAARRLALAPDLSTEQRRRRRQVQADALRRLHELEEQLRDVRARLGLPVLPLPQPLPLSTGSVITTQGVCLGMRLAQLSQEDVVLHSESSSLSESGASHDNEEPHGCFSLAERPSPPKAWDQLRAVSGGSPERRTPWKPPPSDLYGDLKSRRNSVASPTSPTRSLPRSASSFEGRSVPATPVLTRGAGPQLCKPEGLHSRQWSGSQDSQMGFPRADPASDRASLFVARTRRSNSSEALLVDRAAGGGAGSPPAPLAPSASGPPVCKSSEVLYERPQPTPAFSSRTAGPPDPPRAARPSSAAPASRGAPRLPPVCGDFLLDYSLDRGLPRSGGGTGWGELPPAAEVPGPLSRRDGLLTMLPGPPPVYAADSNSPLLRTKDPHTRATRTKPCGLPPEAAEGPEVHPNPLLWMPPPTRIPSAGERSGHKNLALEGLRDWYIRNSGLAAGPQRRPVLPSVGPPHPPFLHARCYEVGQALYGAPSQAPLPHSRSFTAPPVSGRYGGCFY

SEQ ID NO: 18276 - protein, 630 aa, Homo sapiens
  Payload ID: 3648
  Gene Symbol: CCDC120
  Gene Name: coiled-coil domain containing 120
  Uniprot ID: Q96HB5
  ENSP ID: ENSP00000470294
MEVKGQLISSPTFNAPAALFGEAAPQVKSERLRGLLDRQRTLQEALSLKLQELRKVCLQEAELTGQLPPECPLEPGERPQLVRRRPPTARAYPPPHPNQAHHSLCPAEELALEALEREVSVQQQIAAAARRLALAPDLSTEQRRRRRQVQADALRRLHELEEQLRDVRARLGLPVLPLPQPLPLSTGSVITTQGVCLGMRLAQLSQEDVVLHSESSSLSESGASHDNEEPHGCFSLAERPSPPKAWDQLRAVSGGSPERRTPWKPPPSDLYGDLKSRRNSVASPTSPTRSLPRSASSFEGRSVPATPVLTRGAGPQLCKPEGLHSRQWSGSQDSQMGFPRADPASDRASLFVARTRRSNSSEALLVDRAAGGGAGSPPAPLAPSASGPPVCKSSEVLYERPQPTPAFSSRTAGPPDPPRAARPSSAAPASRGAPRLPPVCGDFLLDYSLDRGLPRSGGGTGWGELPPAAEVPGPLSRRDGLLTMLPGPPPVYAADSNSPLLRTKDPHTRATRTKPCGLPPEAAEGPEVHPNPLLWMPPPTRIPSAGERSGHKNLALEGLRDWYIRNSGLAAGPQRRPVLPSVGPPHPPFLHARCYEVGQALYGAPSQAPLPHSRSFTAPPVSGRYGGCFY

SEQ ID NO: 18277 - protein, 696 aa, Homo sapiens
  Payload ID: 3648
  Gene Symbol: CCDC120
  Gene Name: coiled-coil domain containing 120
  Uniprot ID: Q96HB5
  ENSP ID: ENSP00000474071
MRREPRYQGQVGPDIHTDSERTLSSHQPRPLDSTKMEVKGQLISSPTFNAPAALFGEAAPQVKSERLRGLLDRQRTLQEALSLKLQELRKVCLQEAELTGQLPPECPLEPGERPQLVRRRPPTARAYPPPHPNQAHHSLCPAEELALEALEREVSVQQQIAAAARRLALAPDLSTEQRRRRRQVQADALRRLHELEEQLRDVRARLGLPVLPLPQPLPLSTGSVITTQGVCLGMRLAQLSQEDVVLHSESSSLSESGASHDNEEPHGCFSLAERPSPPKAWDQLRAVSGGSPERRTPWKPPPSDLYGDLKSRRNSVASPTSPTRSLPRSASSFEGRSVPATPVLTRGAGPQLCKPEGLHSRQWSGSQDSQMGFPRADPASDRASLFVARTRRSNSSEALLVDRAAGGGAGSPPAPLAPSASGPPVCKSSEVLYERPQPTPAFSSRTAGPPDPPRAARPSSAAPASRGAPRLPPVCGDFLLDYSLDRGLPRSGGGTGWGELPPAAEVPGPLSRRDGLLTMLPGPPPVYAADSNSPLLRTKDPHTRATRTKPCGLPPEAAEGPEVHPNPLLWMPPPTRIPSAGERSGHKNLALEGLRDWYIRNSGLAAGPQRRPVLPSVGPPHPPFLHARCYEVGQALYGAPSQAPLPHSRSFTAPPVSGRYYADFLYPPELSARLSDLTLEGEQSSSSDTQTPGTLV

SEQ ID NO: 18278 - protein, 63 aa, Homo sapiens
  Payload ID: 3648
  Gene Symbol: CCDC120
  Gene Name: coiled-coil domain containing 120
  ENSP ID: ENSP00000474713
MRREPRYQGQVGPDIHTDSERAGQADFVQPSATASRQHQDGSQSCPVRRGCPPGEVRASAGAA

SEQ ID NO: 18279 - protein, 630 aa, Homo sapiens; identical to SEQ ID NO: 18276
  Payload ID: 3648
  Gene Symbol: CCDC120
  Gene Name: coiled-coil domain containing 120
  Uniprot ID: Q96HB5
  ENSP ID: ENSP00000474761

SEQ ID NO: 18280 - protein, 630 aa, Homo sapiens; identical to SEQ ID NO: 18276
  Payload ID: 3648
  Gene Symbol: CCDC120
  Gene Name: coiled-coil domain containing 120
  Uniprot ID: Q96HB5
  ENSP ID: ENSP00000475676

SEQ ID NO: 18281 - protein, 278 aa, Homo sapiens
  Payload ID: 3649
  Gene Symbol: CCDC121
  Gene Name: coiled-coil domain containing 121
  Uniprot ID: Q6ZUS5
  ENSP ID: ENSP00000339087
MTDLNKHIKQAQTQRKQLLEESRELHREKLLVQAENRFFLEYLTNKTEEYTEQPEKVWNSYLQKSGEIERRRQESASRYAEQISVLKTALLQKENIQSSLKRKLQAMRDIAILKEKQEKEIQTLQEETKKVQAETASKTREVQAQLLQEKRLLEKQLSEPDRRLLGKRKRRELNMKAQALKLAAKRFIFEYSCGINRENQQFKKELLQLIEQAQKLTATQSHLENRKQQLQQEQWYLESLIQARQRLQGSHNQCLNRQDVPKTTPSLPQGTKSRINPK

SEQ ID NO: 18282 - protein, 440 aa, Homo sapiens
  Payload ID: 3649
  Gene Symbol: CCDC121
  Gene Name: coiled-coil domain containing 121
  Uniprot ID: Q6ZUS5
  ENSP ID: ENSP00000412150
MGSRGQGSHSKKTRSMPVILSPQRTGSGATGGPAARAYSVAEAVKQFRAGPAGTGAGCSLQGCWAAPRPFEHRTNKLRELSTLAHCSRELQTQVPDASAHSLAVTLSELHSCRDLQDECLDSRFAEGPRRLLPPYHSLINNFVKPEKLTKVETRLKEKIVAEMTDLNKHIKQAQTQRKQLLEESRELHREKLLVQAENRFFLEYLTNKTEEYTEQPEKVWNSYLQKSGEIERRRQESASRYAEQISVLKTALLQKENIQSSLKRKLQAMRDIAILKEKQEKEIQTLQEETKKVQAETASKTREVQAQLLQEKRLLEKQLSEPDRRLLGKRKRRELNMKAQALKLAAKRFIFEYSCGINRENQQFKKELLQLIEQAQKLTATQSHLENRKQQLQQEQWYLESLIQARQRLQGSHNQCLNRQDVPKTTPSLPQGTKSRINPK

SEQ ID NO: 18283 - protein, 144 aa, Homo sapiens
  Payload ID: 3649
  Gene Symbol: CCDC121
  Gene Name: coiled-coil domain containing 121
  ENSP ID: ENSP00000428530
MGSRGQGSHSKKTRSMPVILSPQRTGSGATGGPAARAYSVAEAVKQFRAGPAGTGAGCSLQGCWAAPRPFEHRTNKLRELSTLAHCSRELQTQVPDASAHSLAVTLSELHSCRDLQDECLDSRCKFAEGPRRLLPPYHSLINNF

SEQ ID NO: 18284 - protein, 273 aa, Homo sapiens
  Payload ID: 3650
  Gene Symbol: CCDC122
  Gene Name: coiled-coil domain containing 122
  Uniprot ID: Q5T0U0
  ENSP ID: ENSP00000407763
MSDNKERKSQGFPKEDNQDTSSLADAVEKVAKQQQSQASEIEKNKKVLFNLKNELHELEKEIAAISAETKETERQIYQQDSAIENTKLHCDSLETQIKSLHSENVKLKFDIETAQEDFEEHMIKYNAYYAKIKAHKNSLGEVESKWSFMTELHEKRDFVKKLKTMKEELMQDLQNPGGNRITQVQEDITNLKDKIITVKESIIEKTCFLEEEKKTHEKLRKEIEVQHKRYDAILKRLHCQVNKLQSNRRQWQWNIQQLEKTAAELRKCIGMQE

SEQ ID NO: 18285 - protein, 22 aa, Homo sapiens
  Payload ID: 3650
  Gene Symbol: CCDC122
  Gene Name: coiled-coil domain containing 122
  ENSP ID: ENSP00000480362
KLRKEIEVSLNYLDFNVLWDHF

SEQ ID NO: 18286 - protein, 223 aa, Homo sapiens
  Payload ID: 3651
  Gene Symbol: CCDC124
  Gene Name: coiled-coil domain containing 124
  Uniprot ID: Q96CT7
  ENSP ID: ENSP00000408730
MPKKFQGENTKSAAARARRAEAKAAADAKKQKELEDAYWKDDDKHVMRKEQRKEEKEKRRLDQLERKKETQRLLEEEDSKLKGGKAPRVATSSKVTRAQIEDTLRRDHQLREAPDTAEKAKSHLEVPLEENVNRRVLEEGSVEARTIEDAIAVLSVAEEAADRHPERRMRAAFTAFEEAQLPRLKQENPNMRLSQLKQLLKKEWLRSPDNPMNQRAVPFNAPK

SEQ ID NO: 18287 - protein, 223 aa, Homo sapiens; identical to SEQ ID NO: 18286
  Payload ID: 3651
  Gene Symbol: CCDC124
  Gene Name: coiled-coil domain containing 124
  Uniprot ID: Q96CT7
  ENSP ID: ENSP00000471455

SEQ ID NO: 18288 - protein, 136 aa, Homo sapiens
  Payload ID: 3651
  Gene Symbol: CCDC124
  Gene Name: coiled-coil domain containing 124
  ENSP ID: ENSP00000472520
MPKKFQGENTKSAAARARRAEAKAAADAKKQKELEDAYWKDDDKHVMRKEQRKEEKEKRRLDQLERKKETQRLLEEEDSKLKGGKAPRVATSSKVTRAQIEDTLRRDHQLREAPDTAEKAKSHLEVPLEENVNRRV

SEQ ID NO: 18289 - protein, 312 aa, Homo sapiens
  Payload ID: 3652
  Gene Symbol: CCDC125
  Gene Name: coiled-coil domain containing 125
  ENSP ID: ENSP00000372865
MSKVARSSSESDVQLWETEEDDMTEGDLGYGLGRKPGGIYEIEFSHRSRKRSDGKNFSPPPFPRKGEERNEASFQYSKHKSQQDTFPQVSRISNYRRQSSTDSNSELSNEELRQCLNETLEEVEMLKTELEASQRQLRGKEEALKILQSMAILGKATSHTQAVLQKTMEQNRSLEKEINALQWEIEFDHNRFKNIEESWIQKYDRLNCENAVLKENLKVKTEEIKMLKSDNAVLNQRYLEALAMLDIKQQKMAQENMCCDKSGFAEASGLEDFHHQGVRRPSGRDCWVCSLQKTVLRGWKTRTVLKRSLRCS

SEQ ID NO: 18290 - protein, 511 aa, Homo sapiens
  Payload ID: 3652
  Gene Symbol: CCDC125
  Gene Name: coiled-coil domain containing 125
  Uniprot ID: Q86Z20
  ENSP ID: ENSP00000379754
MSKVARSSSESDVQLWETEEDDMTEGDLGYGLGRKPGGIYEIEFSHRSRKRSDGKNFSPPPFPRKGEERNEASFQYSKHKSQQDTFPQVSRISNYRRQSSTVDSNSELSNEELRQCLNETLEEVEMLKTELEASQRQLRGKEEALKILQSMAILGKATSHTQAVLQKTMEQNRSLEKEINALQWEIEFDHNRFKNIEESWIQKYDRLNCENAVLKENLKVKTEEIKMLKSDNAVLNQRYLEALAMLDIKQQKMAQENMCCDKSGFAEASGLELAVLGACLCHGPGGNPCSCARMAASTRKLLLQLKQELEILQKSKEEAYVMADAFRIAFEQQLMRKNDQALQLTQMDKMHKKATKWMNWKHLKEDGFPSPRSKKTFGQRLLGMLPSENSSKRMEDQDSPQEVLKMLIDLLNDKEEALAHQRKVSYMLARALEDKDTASNENKEKNPIKENFPFNNPWRKTSEFSVLGDPIHSSVCILNSVGCICSIQHSQIDPNYRTLKRSHSLPSSIIF

SEQ ID NO: 18291 - protein, 511 aa, Homo sapiens; identical to SEQ ID NO: 18290
  Payload ID: 3652
  Gene Symbol: CCDC125
  Gene Name: coiled-coil domain containing 125
  Uniprot ID: Q86Z20
  ENSP ID: ENSP00000379756

SEQ ID NO: 18292 - protein, 386 aa, Homo sapiens
  Payload ID: 3652
  Gene Symbol: CCDC125
  Gene Name: coiled-coil domain containing 125
  Uniprot ID: Q86Z20
  ENSP ID: ENSP00000426795
MLKTELEASQRQLRGKEEALKILQSMAILGKATSHTQAVLQKTMEQNRSLEKEINALQWEIEFDHNRFKNIEESWIQKYDRLNCENAVLKENLKVKTEEIKMLKSDNAVLNQRYLEALAMLDIKQQKMAQENMCCDKSGFAEASGLELAVLGACLCHGPGGNPCSCARMAASTRKLLLQLKQELEILQKSKEEAYVMADAFRIAFEQQLMRKNDQALQLTQMDKMHKKATKWMNWKHLKEDGFPSPRSKKTFGQRLLGMLPSENSSKRMEDQDSPQEVLKMLIDLLNDKEEALAHQRKVSYMLARALEDKDTASNENKEKNPIKENFPFNNPWRKTSEFSVLGDPIHSSVCILNSVGCICSIQHSQIDPNYRTLKRSHSLPSSIIF

SEQ ID NO: 18293 - protein, 511 aa, Homo sapiens; identical to SEQ ID NO: 18290
  Payload ID: 3652
  Gene Symbol: CCDC125
  Gene Name: coiled-coil domain containing 125
  Uniprot ID: Q86Z20
  ENSP ID: ENSP00000479651

SEQ ID NO: 18294 - protein, 312 aa, Homo sapiens; identical to SEQ ID NO: 18289
  Payload ID: 3652
  Gene Symbol: CCDC125
  Gene Name: coiled-coil domain containing 125
  ENSP ID: ENSP00000481171

SEQ ID NO: 18295 - protein, 511 aa, Homo sapiens; identical to SEQ ID NO: 18290
  Payload ID: 3652
  Gene Symbol: CCDC125
  Gene Name: coiled-coil domain containing 125
  Uniprot ID: Q86Z20
  ENSP ID: ENSP00000481190

SEQ ID NO: 18296 - protein, 386 aa, Homo sapiens; identical to SEQ ID NO: 18292
  Payload ID: 3652
  Gene Symbol: CCDC125
  Gene Name: coiled-coil domain containing 125
  Uniprot ID: Q86Z20
  ENSP ID: ENSP00000484313

SEQ ID NO: 18297 - protein, 140 aa, Homo sapiens
  Payload ID: 3653
  Gene Symbol: CCDC126
  Gene Name: coiled-coil domain containing 126
  Uniprot ID: Q96EE4
  ENSP ID: ENSP00000304355
MFFTISRKNMSQKLSLLLLVFGLIWGLMLLHYTFQQPRHQSSVKLREQILDLSKRYVKALAEENKNTVDVENGASMAGYADLKRTIAVLLDDILQRLVKLENKVDYIVVNGSAANTTNGTSGNLVPVTTNKRTNVSGSIR

SEQ ID NO: 18298 - protein, 140 aa, Homo sapiens; identical to SEQ ID NO: 18297
  Payload ID: 3653
  Gene Symbol: CCDC126
  Gene Name: coiled-coil domain containing 126
  Uniprot ID: Q96EE4
  ENSP ID: ENSP00000386355

SEQ ID NO: 18299 - protein, 140 aa, Homo sapiens; identical to SEQ ID NO: 18297
  Payload ID: 3653
  Gene Symbol: CCDC126
  Gene Name: coiled-coil domain containing 126
  Uniprot ID: Q96EE4
  ENSP ID: ENSP00000386675

SEQ ID NO: 18300 - protein, 110 aa, Homo sapiens
  Payload ID: 3653
  Gene Symbol: CCDC126
  Gene Name: coiled-coil domain containing 126
  ENSP ID: ENSP00000406558
MFFTISRKNMSQKLSLLLLVFGLIWGLMLLHYTFQQPRHQSSVKLREQILDLSKRYVKALAEENKNTVDVENGASMAGYADLKRTIAVLLDDILQRLVKLENKVDYIVVN

SEQ ID NO: 18301 - protein, 260 aa, Homo sapiens
  Payload ID: 3654
  Gene Symbol: CCDC127
  Gene Name: coiled-coil domain containing 127
  Uniprot ID: Q96BQ5
  ENSP ID: ENSP00000296824
MNNLNDPPNWNIRPNSRADGGDGSRWNYALLVPMLGLAAFRWIWSRESQKEVEKEREAYRRRTAAFQQDLEAKYHAMISENRRAVAQLSLELEKEQNRTASYREALISQGRKLVEEKKLLEQERAQVMQEKRQVQPLRSAYLSCLQREENWQRRARLLLKEFEAVLTERQNIYCSLFLPRSKRLEIEKSLLVRASVDPVAADLEMAAGLTDIFQHDTYCGDVWNTNKRQNGRLMWLYLKYWELVVELKKFKRVEEAILEK

SEQ ID NO: 18302 - protein, 69 aa, Homo sapiens
  Payload ID: 3654
  Gene Symbol: CCDC127
  Gene Name: coiled-coil domain containing 127
  ENSP ID: ENSP00000411206
MNNLNDPPNWNIRPNSRADGGDGSRWNYALLVPMLGLAAFRWIWSRESQKEVEKEREAYRRRTAAFQQD

SEQ ID NO: 18303 - protein, 896 aa, Homo sapiens
  Payload ID: 3655
  Gene Symbol: CCDC129
  Gene Name: coiled-coil domain containing 129
  Uniprot ID: Q6ZRS4
  ENSP ID: ENSP00000313062
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGGTQLAAFTPPTLENSTRMSPSSSAWAKLGPTPLSNCPVGEKDADVFL

SEQ ID NO: 18304 - protein, 1044 aa, Homo sapiens
  Payload ID: 3655
  Gene Symbol: CCDC129
  Gene Name: coiled-coil domain containing 129
  Uniprot ID: Q6ZRS4
  ENSP ID: ENSP00000384416
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVSAAKEHRRRMGKLLRRASKQNIRRDCNPEVSESFKVKDEVFVPFTKPWDCGAELAATSINHKQNHLSLSVEHQSLQACDDLLPYPPHGLLSKQWPCSSMPAKQAPPSCVSEGSVKGRTQKENLFQTNKLKSLSHLAGKGPDSFEMEEVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGGTQLAAFTPPTLENSTRMSPSSSAWAKLGPTPLSNCPVGEKDADVFL

SEQ ID NO: 18305 - protein, 952 aa, Homo sapiens
  Payload ID: 3655
  Gene Symbol: CCDC129
  Gene Name: coiled-coil domain containing 129
  Uniprot ID: Q6ZRS4
  ENSP ID: ENSP00000387214
MVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVSAAKEHRRRMGKLLRRASKQNIRRDCNPEVSESFKVKDEVFVPFTKPWDCGAELAATSINHKQNHLSLSVEHQSLQACDDLLPYPPHGLLSKQWPCSSMPAKQAPPSCVSEGSVKGRTQKENLFQTNKLKSLSHLAGKGPDSFEMEEVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGGTQLAAFTPPTLENSTRMSPSSSAWAKLGPTPLSNCPVGEKDADVFL

SEQ ID NO: 18306 - protein, 142 aa, Homo sapiens
  Payload ID: 3655
  Gene Symbol: CCDC129
  Gene Name: coiled-coil domain containing 129
  ENSP ID: ENSP00000387220
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEI

SEQ ID NO: 18307 - protein, 168 aa, Homo sapiens
  Payload ID: 3655
  Gene Symbol: CCDC129
  Gene Name: coiled-coil domain containing 129
  ENSP ID: ENSP00000390544
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARF

SEQ ID NO: 18308 - protein, 1062 aa, Homo sapiens
  Payload ID: 3655
  Gene Symbol: CCDC129
  Gene Name: coiled-coil domain containing 129
  Uniprot ID: Q6ZRS4
  ENSP ID: ENSP00000395835
MPTTASCKTISLLKLLYSVSLQNYSPMMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVSAAKEHRRRMGKLLRRASKQNIRRDCNPEVSESFKVKDEVFVPFTKPWDCGAELAATSINHKQNHLSLSVEHQSLQACDDLLPYPPHGLLSKQWPCSSMPAKQAPPSCVSEGSVKGRTQKENLFQTNKLKSLSHLAGKGPDSFEMEEVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGELLSAELDPFFFSSKANNSAKDEKIKSKDFLKTQDSGLL

SEQ ID NO: 18309 - protein, 163 aa, Homo sapiens
  Payload ID: 3655
  Gene Symbol: CCDC129
  Gene Name: coiled-coil domain containing 129
  ENSP ID: ENSP00000413233
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQ

SEQ ID NO: 18310 - protein, 1054 aa, Homo sapiens
  Payload ID: 3655
  Gene Symbol: CCDC129
  Gene Name: coiled-coil domain containing 129
  ENSP ID: ENSP00000478518
MSVSLQNYSPMMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVSAAKEHRRRMGKLLRRASKQNIRRDCNPEVSESFKVKDEVFVPFTKPWDCGAELAATSINHKQNHLSLSVEHQSLQACDDLLPYPPHGLLSKQWPCSSMPAKQAPPSCVSEGSVKGRTQKENLFQTNKLKSLSHLAGKGPDSFEMEEVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGGTQLAAFTPPTLENSTRMSPSSSAWAKLGPTPLSNCPVGEKDADVFL

SEQ ID NO: 18311 - protein, 715 aa, Homo sapiens
  Payload ID: 3656
  Gene Symbol: CCDC13
  Gene Name: coiled-coil domain containing 13
  Uniprot ID: Q8IYE1
  ENSP ID: ENSP00000309836
MAADESSQNTLRLQFKAMQEMQHKRLQKQMEKKREKELSLKSRADDQEEPLEVSDGLSLLHAGEPNSKNSFEKRVLEDEIEHLRNELRETVDENGRLYKLLKERDFEIKHLKKKIEEDRFAFTGTAGVAGDVVATKIVELSKKNRLLMAESEGAKTRVKQLTNRIQELERELQTALTRLSAKGATDAGAKPPRAQMGDRALLETPEVKALQDRLVATNLKMSDLRNQIQSVKQELRMAQKVLAREVGEDINVQQLLSSPGTWRGRAQQILVLQSKVQELEKQLGQARSQSAGTASDELSVYPDPRKLSAQEKNLLRIRSLEREKQEGLEKLASERDVLQRELEELKKKFEGMRSRNKLLSSEMKTLKSQMGTLVEKGRHDDELIDALMDQLKQLQEILGSLSLQEEKTRVSQHHLDQQLNSEAQRSNSLVAQLQAMVAEREAKVRQLEMEIGQLNVHYLRNKGVGEGSSGREVSPAYTQFLEDPGLTKSPASAGDHVGRLGSSRSVTSLGHTLVESALTRPSLPSPHRTSPRFSDSPEQKGWQAQVSEIKALWQAAEVERDRLTEFVTVLQKRVEESNSKLLESERKLQEERHRTVVLEQHLEKIRLEPGKASASQRAAPRTKTGLPTSNNRHNPTGSEKKDPSFAQLSDVPVESQMEELTTRLAIQVEENEMLKAALGSALRGKEEDFRMYHEILGQVKSVFLQALRQQKTGKQ

SEQ ID NO: 18312 - protein, 396 aa, Homo sapiens
  Payload ID: 3657
  Gene Symbol: CCDC130
  Gene Name: coiled-coil domain containing 130
  Uniprot ID: P13994
  ENSP ID: ENSP00000221554
MGERKGVNKYYPPDFNPEKHGSLNRYHNSHPLRERARKLSQGILIIRFEMPYNIWCDGCKNHIGMGVRYNAEKKKVGNYYTTPIYRFRMKCHLCVNYIEMQTDPANCDYVIVSGAQRKEERWDMADNEQVLTTEHEKKQKLETDAMFRLEHGEADRSTLKKALPTLSHIQEAQSAWKDDFALNSMLRRRFREKKKAIQEEEERDQALQAKASLTIPLVPETEDDRKLAALLKFHTLDSYEDKQKLKRTEIISRSWFPSAPGSASSSKVSGVLKKLAQSRRTALATSPITVGDLGIVRRRSRDVPESPQHAADTPKSGEPRVPEEAAQDRPMSPGDCPPETTETPKCSSPRGQEGSRQDKPLSPAGSSQEAADTPDTRHPCSLGSSLVADYSDSESE

SEQ ID NO: 18313 - protein, 190 aa, Homo sapiens
  Payload ID: 3657
  Gene Symbol: CCDC130
  Gene Name: coiled-coil domain containing 130
  ENSP ID: ENSP00000465392
  MOD_RES (1)..(1): Any amino acid
XNRYHNSHPLRERARKLSQGILIIRFEMPYNIWCDGCKNHIGMGVRYNAEKKKVGNYYTTPIYRFRMKCHLCVNYIEMQTDPANCDYVIVSGAQRKEERWDMADNEQVLTTEAGDGRHVPAGAWRGRPQHTQEGAAHTEPHPGGPERLEGRLRPQQHAAEKVPGEGGSSPGSERMHGGPRPGSSPPPTTS

SEQ ID NO: 18314 - protein, 396 aa, Homo sapiens; identical to SEQ ID NO: 18312
  Payload ID: 3657
  Gene Symbol: CCDC130
  Gene Name: coiled-coil domain containing 130
  Uniprot ID: P13994
  ENSP ID: ENSP00000465776

SEQ ID NO: 18315 - protein, 237 aa, Homo sapiens
  Payload ID: 3657
  Gene Symbol: CCDC130
  Gene Name: coiled-coil domain containing 130
  ENSP ID: ENSP00000466095
MPYNIWCDGCKNHIGMGVRYNAEKKKVGNYYTTPIYRFRMKCHLCVNYIEMQTDPANCDYVIVSGAQRKEERWDMADNEQVLTTEHEKKQKLETDAMFRLEHGEADRSTLKKALPTLSHIQEAQSAWKDDFALNSMLRRRFREKKKAIQEEEERDQALQAKASLTIPLVPETEDDRKLAALLKFHTLDSYEDKQKLKRTEIISRSWFPSAPGSASSSKVSGVLKKLAQSRRTALATS

SEQ ID NO: 18316 - protein, 60 aa, Homo sapiens
  Payload ID: 3657
  Gene Symbol: CCDC130
  Gene Name: coiled-coil domain containing 130
  ENSP ID: ENSP00000467202
MQTDPANCDYVIVSGAQRKEERWDMADNEQVLTTGERHPLTCLGALALSLRWGPQSPAEL

SEQ ID NO: 18317 - protein, 102 aa, Homo sapiens
  Payload ID: 3657
  Gene Symbol: CCDC130
  Gene Name: coiled-coil domain containing 130
  ENSP ID: ENSP00000468544
KQKLETDAMFRLEHGEADRSTLKKALPTLSHIQEAQSAWKDDFALNSMLRRRFREKKKAIQEEEERDQALQAKASLTIPLVPETEDDRKLAALLKFHTLDCA

SEQ ID NO: 18318 - protein, 229 aa, Homo sapiens
  Payload ID: 3658
  Gene Symbol: CCDC134
  Gene Name: coiled-coil domain containing 134
  Uniprot ID: Q9H6E4
  ENSP ID: ENSP00000255784
MDLLQFLAFLFVLLLSGMGATGTLRTSLDPSLEIYKKMFEVKRREQLLALKNLAQLNDIHQQYKILDVMLKGLFKVLEDSRTVLTAADVLPDGPFPQDEKLKDAFSHVVENTAFFGDVVLRFPRIVHYYFDHNSNWNLLIRWGISFCNQTGVFNQGPHSPILSLMAQELGISEKDSNFQNPFKIDRTEFIPSTDPFQKALREEEKRRKKEEKRKEIRKGPRISRSQSEL

SEQ ID NO: 18319 - protein, 116 aa, Homo sapiens
  Payload ID: 3658
  Gene Symbol: CCDC134
  Gene Name: coiled-coil domain containing 134
  ENSP ID: ENSP00000385803
MDLLQFLAFLFVLLLSGMGATGTLRTSLDPSLEIYKKMFEVKRREQLLALKNLAQLNDIHQQYKILDVMLKGLFKFIPSTDPFQKALREEEKRRKKEEKRKEIRKGPRISRSQSEL

SEQ ID NO: 18320 - protein, 1154 aa, Homo sapiens
  Payload ID: 3659
  Gene Symbol: CCDC136
  Gene Name: coiled-coil domain containing 136
  Uniprot ID: Q96JN2
  ENSP ID: ENSP00000297788
MQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKQVKEEAKEQCGDELVAEPADPEEAKSTEDQEENEEDKEEEEKEEDSEEEEDDADSSLESPEENNPLRLSESKKSSPTPNPPIFSLPLVGLVVISALLWCWWAETSS

SEQ ID NO: 18321 - protein, 434 aa, Homo sapiens
  Payload ID: 3659
  Gene Symbol: CCDC136
  Gene Name: coiled-coil domain containing 136
  Uniprot ID: Q96JN2
  ENSP ID: ENSP00000367956
MEAGAGAGAGAAGWSCPGPGPTVTTLGSYEASEGCERKKGQRWGSLERRGMQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQSSPTPNPPIFSLPLVGLVVISALLWCWWAETSS

SEQ ID NO: 18322 - protein, 5 aa, Homo sapiens
  Payload ID: 3659
  Gene Symbol: CCDC136
  Gene Name: coiled-coil domain containing 136
  ENSP ID: ENSP00000417209
MQAME

SEQ ID NO: 18323 - protein, 102 aa, Homo sapiens
  Payload ID: 3659
  Gene Symbol: CCDC136
  Gene Name: coiled-coil domain containing 136
  ENSP ID: ENSP00000417708
MQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQ

SEQ ID NO: 18324 - protein, 1034 aa, Homo sapiens
  Payload ID: 3659
  Gene Symbol: CCDC136
  Gene Name: coiled-coil domain containing 136
  ENSP ID: ENSP00000417931
  MOD_RES (1)..(1): Any amino acid
XISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKQVKEEAKEQCGDELVAEPADPEEAKSTEDQEENEEDKEEEEKEEDSEEEEDDADSSLESPEENNPLRLSESKKNMFGLWKPMVFLAIAAVALYVLPNMRQQESEFCLME

SEQ ID NO: 18325 - protein, 548 aa, Homo sapiens
  Payload ID: 3659
  Gene Symbol: CCDC136
  Gene Name: coiled-coil domain containing 136
  ENSP ID: ENSP00000417991
VENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNENMFGLWKPMVFLAIAAVALYVLPNMRQQESEFCLME

SEQ ID NO: 18326 - protein, 63 aa, Homo sapiens
  Payload ID: 3659
  Gene Symbol: CCDC136
  Gene Name: coiled-coil domain containing 136
  ENSP ID: ENSP00000418042
MQAMEGEVLLPALYEEEEEEEEEEEEVEEEEEQVQKGGSVGSLSVNKHRGLSLTETELEELRA

SEQ ID NO: 18327 - protein, 137 aa, Homo sapiens
  Payload ID: 3659
  Gene Symbol: CCDC136
  Gene Name: coiled-coil domain containing 136
  ENSP ID: ENSP00000418838
MQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELK

SEQ ID NO: 18328 - protein, 446 aa, Homo sapiens
  Payload ID: 3659
  Gene Symbol: CCDC136
  Gene Name: coiled-coil domain containing 136
  ENSP ID: ENSP00000419515
MEAGAGAGAGAAGWSCPGPGPTVTTLGSYEASEGCERKKGQRWGSLERRGMQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQSSPTPNPPIFSLPLVGLVVISALLWCWWAETSS

SEQ ID NO: 18329 - protein, 515 aa, Homo sapiens
  Payload ID: 3659
  Gene Symbol: CCDC136
  Gene Name: coiled-coil domain containing 136
  ENSP ID: ENSP00000420509
MQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKSSPTPNPPIFSLPLVGLVVISALLWCWWAETSS

SEQ ID NO: 18330 - protein, 289 aa, Homo sapiens
  Payload ID: 3660
  Gene Symbol: CCDC137
  Gene Name: coiled-coil domain containing 137
  Uniprot ID: Q6PK04
  ENSP ID: ENSP00000329360
MAGAGRGAAVSRVQAGPGSPRRARGRQQVQPLGKQRPAPWPGLRSKEKKKVNCKPKNQDEQEIPFRLREIMRSRQEMKNPISNKKRKKAAQVTFRKTLEKEAKGEEPDIAVPKFKQRKGESDGAYIHRMQQEAQHVLFLSKNQAIRQPEVQAAPKEKSEQKKAKKAFQKRRLDKVRRKKEEKAADRLEQELLRDTVKFGEVVLQPPELTARPQRSVSKDQPGRRSQMLRMLLSPGGVSQPLTASLARQRIVEEERERAVQAYRALKQRQQQLHGERPHLTSRKKPEPQL

SEQ ID NO: 18331 - protein, 292 aa, Homo sapiens
  Payload ID: 3660
  Gene Symbol: CCDC137
  Gene Name: coiled-coil domain containing 137
  ENSP ID: ENSP00000458350
MAGAGRGAAVSRVQAGPGSPRRARGRQQVQPLGKQRPAPWPGLRSKEKKKVNCKPKNQDEQEIPFRLREIMRSRQEMKNPISNKKRKKAAVLQWTSVTAQVTFRKTLEKEAKGEEPDIAVPKFKQRKGESDGAYIHRMQQEAQHVLFLSKNQAIRQPEVQAAPKEKSEQKKAKKAFQKRRLDKVRRKKEEKAADRLEQELLRDTVKFGEVVLQPPELTARPQRSVSKDQPGRRSQMLRMLLSPGGVSQPLTASLARQRIVEEERERAVQAYRALKQRQQQLHGERPHLTSRK

SEQ ID NO: 18332 - protein, 289 aa, Homo sapiens; identical to SEQ ID NO: 18330
  Payload ID: 3660
  Gene Symbol: CCDC137
  Gene Name: coiled-coil domain containing 137
  Uniprot ID: Q6PK04
  ENSP ID: ENSP00000458884

SEQ ID NO: 18333 - protein, 61 aa, Homo sapiens
  Payload ID: 3660
  Gene Symbol: CCDC137
  Gene Name: coiled-coil domain containing 137
  ENSP ID: ENSP00000460261
DEQEIPFRLREIMRSRQEMKNPISNKKRKKAGDLQKDIGEGSKGRGARHRSPQVQTEEGGV

SEQ ID NO: 18334 - protein, 44 aa, Homo sapiens
  Payload ID: 3660
  Gene Symbol: CCDC137
  Gene Name: coiled-coil domain containing 137
  ENSP ID: ENSP00000461207
  MOD_RES (1)..(1): Any amino acid
XGAGRGAAVSRVQAGPGSPRRARGRQQVQPLGKQRPAPWPGLRR

SEQ ID NO: 18335 - protein, 665 aa, Homo sapiens
  Payload ID: 3661
  Gene Symbol: CCDC138
  Gene Name: coiled-coil domain containing 138
  Uniprot ID: Q96M89
  ENSP ID: ENSP00000295124
MEPRVVKPPGQDLVVESLKSRYGLGGSCPDEYDFSNFYQSKYKRRTLTSPGDLDIYSGDKVGSSLKYSDESKHCRTPLGSLFKHVNVNCLDDELDSFHDLKKQETEEELIENDYRVSTSKITKQSFKEIEKVALPTNTTSSRPRTECCSDAGDSPLKPVSCPKSKASDKRSLLPHQISQIYDELFQIHLKLQCETAAQQKFAEELQKRERFLLEREQLLFRHENALSKIKGVEEEVLTRFQIIKEQHDAEVEHLTEVLKEKNKETKRLRSSFDALKELNDTLKKQLNEASEENRKIDIQAKRVQARLDNLQRKYEFMTIQRLKGSSHAVHEMKSLKQEKAPVSKTYKVPLNGQVYELLTVFMDWISDHHLSKVKHEESGMDGKKPQLKFASQRNDIQEKCVKLLPLMTEQLQWMPFVNIKLHEPFVKFIYWSLRQLDAGAQHSTMTSTLRRLGEDIFKGVVTKGIQDNSPQHSVENKPKTAAFFKSSNLPLRFLSTLIVLKTVTQADYLAQAFDSLCLDLKTEEGKTLFLEYQAVPVILSHLRISSKGLLSNVIDSLLQMTVESKSLQPFLEACSNSLFFRTCSVLLRAPKLDLQILEKLSIILQKLSKIKSNKKLFELFTIHLMLQEIQRTTNPEHAFLCINLNSTLFNLGLTKCNSLVSSASP

SEQ ID NO: 18336 - protein, 104 aa, Homo sapiens
  Payload ID: 3661
  Gene Symbol: CCDC138
  Gene Name: coiled-coil domain containing 138
  ENSP ID: ENSP00000386418
MEPRVVKPPGQDLVVESLKSRYGLGGSCPDEYDFSNFYQSKYKRRTLTSPGDLDIYSGDKVGSSLKYSDESKHCRTPLGSLFKHVNVNCLKNVFTFFLSYAVNI

SEQ ID NO: 18337 - protein, 352 aa, Homo sapiens
  Payload ID: 3661
  Gene Symbol: CCDC138
  Gene Name: coiled-coil domain containing 138
  ENSP ID: ENSP00000392385
  MOD_RES (1)..(1): Any amino acid
XETEEELIENDYRVSTSKITKQSFKEIEKVALPTNTTSSRPRTECCSDAGDSPLKPVSCPKSKASDKRSLLPHQISQIYDELFQIHLKLQCETAAQQKFAEELQKRERFLLEREQLLFRHENALSKIKGVEEEVLTRFQIIKEHDAEVEHLTEVLKEKNKETKRLRSSFDALKELNDTLKKQLNEASEENRKIDIQAKRVQARLDNLQRKYEFMTIQRLKGSSHAVHEMKSLKQEKAPVSKTYKVPLNGQVYELLTVFMDWISDHHLSKVKHEESGMDGKKPQLKFASQRNDIQEKCVKLLPLMTEQLQWMPFVNIKLHEPFVKFIYWSLRQLDAGAQHSTMTSTLRRLGED

SEQ ID NO: 18338 - protein, 45 aa, Homo sapiens
  Payload ID: 3661
  Gene Symbol: CCDC138
  Gene Name: coiled-coil domain containing 138
  ENSP ID: ENSP00000407328
MEPRVVKPPGQDLVVESLKSRYGLGGSCPDEVIWISTLEIKLVHR

SEQ ID NO: 18339 - protein, 577 aa, Homo sapiens
  Payload ID: 3661
  Gene Symbol: CCDC138
  Gene Name: coiled-coil domain containing 138
  Uniprot ID: Q96M89
  ENSP ID: ENSP00000411800
MEPRVVKPPGQDLVVESLKSRYGLGGSCPDEYDFSNFYQSKYKRRTLTSPGDLDIYSGDKVGSSLKYSDESKHCRTPLGSLFKHVNVNCLDDELDSFHDLKKQETEEELIENDYRVSTSKITKQSFKEIEKVALPTNTTSSRPRTECCSDAGDSPLKPVSCPKSKASDKRSLLPHQISQIYDELFQIHLKLQCETAAQQKFAEELQKRERFLLEREQLLFRHENALSKIKGVEEEVLTRFQIIKEQHDAEVEHLTEVLKEKNKETKRLRSSFDALKELNDTLKKQLNEASEENRKIDIQAKRVQARLDNLQRKYEFMTIQRLKGSSHAVHEMKSLKQEKAPVSKTYKVPLNGQVYELLTVFMDWISDHHLSKVKHEESGMDGKKPQLKFASQRNDIQEKCVKLLPLMTEQLQWMPFVNIKLHEPFVKFIYWSLRQLDAGAQHSTMTSTLRRLGEDIFKGVVTKGIQDNSPQHSVENKPKTAAFFKSSNLPLRFLSTLIVLKTVTQADYLAQAFDSLCLDLKTEEGKTLFLEYQAVPVILSHLRISSKGLLSNVIDSLLQMTVESRVIRSSLNFLRFI

SEQ ID NO: 18340 - protein, 39 aa, Homo sapiens
  Payload ID: 3661
  Gene Symbol: CCDC138
  Gene Name: coiled-coil domain containing 138
  ENSP ID: ENSP00000477316
SNVIDSLLQMTVESSHPPCPSDVHMSLHFLLRPPLSLTI

SEQ ID NO: 18341 - protein, 864 aa, Homo sapiens
  Payload ID: 3662
  Gene Symbol: CCDC14
  Gene Name: coiled-coil domain containing 14
  ENSP ID: ENSP00000312031
MVRSGARPGQVLSSGRHTGPAKLTNGKKATYLRKIPRFNADSGYSIHSDSESQAETVHGLDGCASLLRDILRNEDSASSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 18342 - protein, 52 aa, Homo sapiens
  Payload ID: 3662
  Gene Symbol: CCDC14
  Gene Name: coiled-coil domain containing 14
  ENSP ID: ENSP00000386481
GGRAKKVREPTAVNSFYREASLPSVWASLRRREMVRSGARPGQDLFKKNTTF

SEQ ID NO: 18343 - protein, 905 aa, Homo sapiens
  Payload ID: 3662
  Gene Symbol: CCDC14
  Gene Name: coiled-coil domain containing 14
  ENSP ID: ENSP00000386866
MVRSGARPGQVLSSGRHTGPAKLTNGKKATYLRKIPRFNADSGYSIHSDSESQAETVHGLDGCASLLRDILRNEDSGSETAYLENRSNSRPLESKRYGSKKKRHEKHTIPLVVQKETSSSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 18344 - protein, 117 aa, Homo sapiens
  Payload ID: 3662
  Gene Symbol: CCDC14
  Gene Name: coiled-coil domain containing 14
  ENSP ID: ENSP00000387962
MYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPK

SEQ ID NO: 18345 - protein, 912 aa, Homo sapiens
  Payload ID: 3662
  Gene Symbol: CCDC14
  Gene Name: coiled-coil domain containing 14
  Uniprot ID: Q49A88
  ENSP ID: ENSP00000395706
MKRGIRRDPFRKRKLGGRAKKVREPTAVNSFYREASLPSVWASLRRREMVRSGARPGQVLSSGRHTGPAKLTNGKKATYLRKIPRFNADSGYSIHSDSESQAETVHGLDGCASLLRDILRNEDSASSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 18346 - protein, 64 aa, Homo sapiens
  Payload ID: 3662
  Gene Symbol: CCDC14
  Gene Name: coiled-coil domain containing 14
  ENSP ID: ENSP00000398148
MKRGIRRDPFRKRKLGGRAKKVREPTAVNSFYREASLPSVWASLRRREMVRSGARPGQVQKQHI

SEQ ID NO: 18347 - protein, 312 aa, Homo sapiens
  Payload ID: 3662
  Gene Symbol: CCDC14
  Gene Name: coiled-coil domain containing 14
  ENSP ID: ENSP00000400957
MYSPIIYQALCEHVQTQMSLMNDLTSKNIPNGIPAVPCHAPSHSESQATPHSSYGLCTSTPVWSLQRPPCPPKVHSEVQTDGNSQFASQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRSTPEKKSPLSKRLSPQPQIRAATTQLVSNS

SEQ ID NO: 18348 - protein, 37 aa, Homo sapiens
  Payload ID: 3662
  Gene Symbol: CCDC14
  Gene Name: coiled-coil domain containing 14
  ENSP ID: ENSP00000407820
  MOD_RES (1)..(1): Any amino acid
XYREASLPSVWASLRRREMVRSGARPGQDLFKKNTTF

SEQ ID NO: 18349 - protein, 174 aa, Homo sapiens
  Payload ID: 3662
  Gene Symbol: CCDC14
  Gene Name: coiled-coil domain containing 14
  ENSP ID: ENSP00000414655
MYSPIIYQALCEHVQTQMSLMNDLTSKNIPNGIPAVPCHAPSHSESQATPHSSYGLCTSTPVWSLQRPPCPPKVHSEVQTDGNSQFASQETHLDSQTHRSPTQSQPAFLATNEEKCAREQIREATSERKDLNIHVRDTKTVKDVQKAKNVNKTAEKVRIIKYLLGELKALVAEQ

SEQ ID NO: 18350 - protein, 753 aa, Homo sapiens
  Payload ID: 3662
  Gene Symbol: CCDC14
  Gene Name: coiled-coil domain containing 14
  Uniprot ID: Q49A88
  ENSP ID: ENSP00000418002
MYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 18351 - protein, 753 aa, Homo sapiens; identical to SEQ ID NO: 18350
  Payload ID: 3662
  Gene Symbol: CCDC14
  Gene Name: coiled-coil domain containing 14
  Uniprot ID: Q49A88
  ENSP ID: ENSP00000418403

SEQ ID NO: 18352 - protein, 912 aa, Homo sapiens; identical to SEQ ID NO: 18345
  Payload ID: 3662
  Gene Symbol: CCDC14
  Gene Name: coiled-coil domain containing 14
  Uniprot ID: Q49A88
  ENSP ID: ENSP00000420180

SEQ ID NO: 18353 - protein, 257 aa, Homo sapiens
  Payload ID: 3662
  Gene Symbol: CCDC14
  Gene Name: coiled-coil domain containing 14
  ENSP ID: ENSP00000420768
  MOD_RES (1)..(1): Any amino acid
XKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRLFKTVDLNVLQSLTQKPNTVHELRKSRTALNKEE

SEQ ID NO: 18354 - protein, 163 aa, Homo sapiens
  Payload ID: 3663
  Gene Symbol: CCDC140
  Gene Name: coiled-coil domain containing 140
  Uniprot ID: Q96MF4
  ENSP ID: ENSP00000295226
MGDECSNPDLLAEPGSSPPWDHGNQRQEAANESNTRVPRVLKAHLGPETAQPTKRSKRNRWRRQSCQGPSPARSGQFLGSADLGLQRGVLKSAARTCLSEISNSTRASPESAQSTDPGRAARPRTRTLPTPHSFKIGEEAEEMKKKKERKRRKERKKERNFKK

SEQ ID NO: 18355 - protein, 17 aa, Homo sapiens
  Payload ID: 3663
  Gene Symbol: CCDC140
  Gene Name: coiled-coil domain containing 140
  ENSP ID: ENSP00000407652
MGDECSNPDLLAEPGSS

SEQ ID NO: 18356 - protein, 894 aa, Homo sapiens
  Payload ID: 3664
  Gene Symbol: CCDC141
  Gene Name: coiled-coil domain containing 141
  ENSP ID: ENSP00000344627
RSQVLQTYVAFLKSSEEVEMQFQSLKEFYETEIPQKEQDDAKAKHCSDSAEKQWQLFLKKSFITQDLGLEFLNLINMAKENEILDVKNEVYLMKNTMENQKAEREELSLLRLAWQLKATESKPGKQQWAAFKEQLKKTSHNLKLLQEALMPVSALDLGGSLQFILDLRQKWNDMKPQFQQLNDEVQYIMKESEELTGRGAPVKEKSQQLKDLIHFHQKQKERIQDYEDILYKVVQFHQVKEELGRLIKSRELEFVEQPKELGDAHDVQIHLRCSQEKQARVDHLHRLALSLGVDIISSVQRPHCSNVSAKNLQQQLELLEEDSMKWRAKAEEYGRTLSRSVEYCAMRDEINELKDSFKDIKKKFNNLKFNYTKKNEKSRNLKALKYQIQQVDMYAEKMQALKRKMEKVSNKTSDSFLNYPSDKVNVLLEVMKDLQKHVDDFDKVVTDYKKNLDLTEHFQEVIEECHFWYEDASATVVRVGKYSTECKTKEAVKILHQQFNKFIAPSVPQQEERIQEATDLAQHLYGLEEGQKYIEKIVTKHKEVLESVTELCESLTELEEKLKQGDVLKMNPNLEDFHYDYIDLLKEPAKNKQTIFNEERNKGQVQVADLLGINGTGEERLPQDLKVSTDKEGGVQDLLLPEDMLSGEEYECVSPDDISLPPLPGSPESPLAPSDMEVEEPVSSSLSLHISSYGVQAGTSSPGDAQESVLPPPVAFADACNDKRETFSSHFERPYLQFKAEPPLTSRGFVEKSTALHRISAEHPESMMSEVHERALQQHPQAQGGLLETREKMHADNNFTKTQDRLHASSDAFSGLRFQSGTSRGYQRQMVPREEIKSTSAKSSVVSLADQAPNFSRLLSNVTVMEGSPVTLEVEVTGFPEPTLTWWVAYNDKP

SEQ ID NO: 18357 - protein, 652 aa, Homo sapiens
  Payload ID: 3664
  Gene Symbol: CCDC141
  Gene Name: coiled-coil domain containing 141
  ENSP ID: ENSP00000386503
MSSQGSPSVALSTTTVSSVAVQAGDSKIVIAVIKCGKWVQLQLAESQPNLLEIGSSQDETKKLLHDHELLLAKLKALEDRVWELLQEADKTAEENKDQSQVYDAMAETLGEAWAALVSMLERRTELLRLTSEFFENALEFAIKIDQAEDFLQNTHEFESAESLKSLLQLHEHHTKELLERSLALLNKSQQLTDFIEKFKCEGPNVNPELTQGAHSSCLKVDRLLELLQDRRRQLDKYLKQQWQELSQVLQICQWDQQENQVTCWFQKTIRNLQEQSLGSSLSDNEDRIHKQEELIIKAKEWNSAVEKLKSEALRILLSKDYVEKEHLQLSHQKLSQLQEEFGQLMVERNTWLKKANEFFNSANKAFDVLGRVEAYLKLLKSEGLSLAVLAVRHEELHRKIKDCTTDALQKGQTLISQVDSCSSQVSGIHEMMGCIKRRVDHLTEQCSAHKEYALKKQQLTASVEGYLRKVEMSIQKISPVLSNAMDVGSTRSESEKILNKYLELDIQAKETSHELEAAAKTMMEKNEFVSDEMVSLSSKARWLAEELNLFGQSIDYRSQVLQTYVAFLKSSEEVEMQFQSLKEFYETEIPQKEQDDAKAKHCSDSAEKQWQLFLKKSFITQDLGLEFLNLINMVRMALNGSHLLQGYSSKSK

SEQ ID NO: 18358 - protein, 628 aa, Homo sapiens
  Payload ID: 3664
  Gene Symbol: CCDC141
  Gene Name: coiled-coil domain containing 141
  ENSP ID: ENSP00000388745
MSSQGSPSVALSTTTVSSVAVQAGDSKIVIAVIKCGKWVQLQLAESQPNLLEIGSSQDETKKLLHDHELLLAKLKALEDRVWELLQEADKTAEENKDQSQVYDAMAETLGEAWAALVSMLERRTELLRLTSEFFENALEFAIKIDQAEDFLQNTHEFESAESLKSLLQLHEHHTKELLERSLALLNKSQQLTDFIEKFKCEGPNVNPELTQGAHSSCLKVDRLLELLQDRRRQLDKYLKQQWQELSQVLQICQWDQQENQVTCWFQKTIRNLQEQSLGSSLSDNEDRIHKQEELIIKAKAFDVLGRVEAYLKLLKSEGLSLAVLAVRHEELHRKIKDCTTDALQKGQTLISQVDSCSSQVSGIHEMMGCIKRRVDHLTEQCSAHKEYALKKQQLTASVEGYLRKVEMSIQKISPVLSNAMDVGSTRSESEKILNKYLELDIQAKETSHELEAAAKTMMEKNEFVSDEMVSLSSKARWLAEELNLFGQSIDYRSQVLQTYVAFLKSSEEVEMQFQSLKEFYETEIPQKEQDDAKAKHCSDSAEKQWQLFLKKSFITQDLGLEFLNLINMAKENEILDVKNEVYLMKNTMENQKAEREELSLLRLAWQLKATESKPGKQQWAAFKEQLKK

SEQ ID NO: 18359 - protein, 955 aa, Homo sapiens
  Payload ID: 3664
  Gene Symbol: CCDC141
  Gene Name: coiled-coil domain containing 141
  ENSP ID: ENSP00000390190
MSSQGSPSVALSTTTVSSVAVQAGDSKIVIAVIKCGKWVQLQLAESQPNLLEIGSSQDETKKLLHDHELLLAKLKALEDRVWELLQEADKTAEENKDQSQVYDAMAETLGEAWAALVSMLERRTELLRLTSEFFENALEFAIKIDQAEDFLQNTHEFESAESLKSLLQLHEHHTKELLERSLALLNKSQQLTDFIEKFKCEGPNVNPELTQGAHSSCLKVDRLLELLQDRRRQLDKYLKQQWQELSQVLQICQWDQQENQVTCWFQKTIRNLQEQSLGSSLSDNEDRIHKQEELIIKAKEWNSAVEKLKSEALRILLSKDYVEKEHLQLSHQKLSQLQEEFGQLMVERNTWLKKANEFFNSANKAFDVLGRVEAYLKLLKSEGLSLAVLAVRHEELHRKIKDCTTDALQKGQTLISQVDSCSSQVSGIHEMMGCIKRRVDHLTEQCSAHKEYALKKQQLTASVEGYLRKVEMSIQKISPVLSNAMDVGSTRSESEKILNKYLELDIQAKETSHELEAAAKTMMEKNEFVSDEMVSLSSKARWLAEELNLFGQSIDYRSQVLQTYVAFLKSSEEVEMQFQSLKEFYETEIPQKEQDDAKAKHCSDSAEKQWQLFLKKSFITQDLGLEFLNLINMAKENEILDVKNEVYLMKNTMENQKAEREELSLLRLAWQLKATESKPGKQQWAAFKEQLKKTSHNLKLLQEALMPVSALDLGGSLQFILDLRQKWNDMKPQFQQLNDEVQYIMKESEELTGRGAPVKEKSQQLKDLIHFHQKQKERIQDYEDILYKVVQFHQVKEELGRLIKSRELEFVEQPKELGDAHDVQIHLRCSQEKQARVDHLHRLALSLGVDIISSVQRPHCSNVSAKNLQQQLELLEEDSMKWRAKAEEYGRTLSRSVEYCAMRDEINELKDSFKDIKKKFNNLKFNYTKKNEKSRNLKALKYQIQQVDMYAEKMQ

SEQ ID NO: 18360 - protein, 1530 aa, Homo sapiens
  Payload ID: 3664
  Gene Symbol: CCDC141
  Gene Name: coiled-coil domain containing 141
  Uniprot ID: Q6ZP82
  ENSP ID: ENSP00000395995
MSSQGSPSVALSTTTVSSVAVQAGDSKIVIAVIKCGKWVQLQLAESQPNLLEIGSSQDETKKLLHDHELLLAKLKALEDRVWELLQEADKTAEENKDQSQVYDAMAETLGEAWAALVSMLERRTELLRLTSEFFENALEFAIKIDQAEDFLQNTHEFESAESLKSLLQLHEHHTKELLERSLALLNKSQQLTDFIEKFKCEGPNVNPELTQGAHSSCLKVDRLLELLQDRRRQLDKYLKQQWQELSQVLQICQWDQQENQVTCWFQKTIRNLQEQSLGSSLSDNEDRIHKQEELIIKAKEWNSAVEKLKSEALRILLSKDYVEKEHLQLSHQKLSQLQEEFGQLMVERNTWLKKANEFFNSANKAFDVLGRVEAYLKLLKSEGLSLAVLAVRHEELHRKIKDCTTDALQKGQTLISQVDSCSSQVSGIHEMMGCIKRRVDHLTEQCSAHKEYALKKQQLTASVEGYLRKVEMSIQKISPVLSNAMDVGSTRSESEKILNKYLELDIQAKETSHELEAAAKTMMEKNEFVSDEMVSLSSKARWLAEELNLFGQSIDYRSQVLQTYVAFLKSSEEVEMQFQSLKEFYETEIPQKEQDDAKAKHCSDSAEKQWQLFLKKSFITQDLGLEFLNLINMAKENEILDVKNEVYLMKNTMENQKAEREELSLLRLAWQLKATESKPGKQQWAAFKEQLKKTSHNLKLLQEALMPVSALDLGGSLQFILDLRQKWNDMKPQFQQLNDEVQYIMKESEELTGRGAPVKEKSQQLKDLIHFHQKQKERIQDYEDILYKVVQFHQVKEELGRLIKSRELEFVEQPKELGDAHDVQIHLRCSQEKQARVDHLHRLALSLGVDIISSVQRPHCSNVSAKNLQQQLELLEEDSMKWRAKAEEYGRTLSRSVEYCAMRDEINELKDSFKDIKKKFNNLKFNYTKKNEKSRNLKALKYQIQQVDMYAEKMQALKRKMEKVSNKTSDSFLNYPSDKVNVLLEVMKDLQKHVDDFDKVVTDYKKNLDLTEHFQEVIEECHFWYEDASATVVRVGKYSTECKTKEAVKILHQQFNKFIAPSVPQQEERIQEATDLAQHLYGLEEGQKYIEKIVTKHKEVLESVTELCESLTELEEKLKQGDVLKMNPNLEDFHYDYIDLLKEPAKNKQTIFNEERNKGQVQVADLLGINGTGEERLPQDLKVSTDKEGGVQDLLLPEDMLSGEEYECVSPDDISLPPLPGSPESPLAPSDMEVEEPVSSSLSLHISSYGVQAGTSSPGDAQESVLPPPVAFADACNDKRETFSSHFERPYLQFKAEPPLTSRGFVEKSTALHRISAEHPESMMSEVHERALQQHPQAQGGLLETREKMHADNNFTKTQDRLHASSDAFSGLRFQSGTSRGYQRQMVPREEIKSTSAKSSVVSLADQAPNFSRLLSNVTVMEGSPVTLEVEVTGFPEPTLTWYKKGQKLSADGHLQVLHKETRHSVFIPKVCKADAGLYVARAQNSSGALSSNVILHVTGNCRLPITRVNWITLCVVYVSVSLMYWLLTQ

SEQ ID NO: 18361 - protein, 743 aa, Homo sapiens
  Payload ID: 3665
  Gene Symbol: CCDC142
  Gene Name: coiled-coil domain containing 142
  Uniprot ID: Q17RM4
  ENSP ID: ENSP00000290418
MAQASRSGSLPPLVIVPPLRAQPGGTGEEQWERSRTGGLRWEVHCWPSGTSGGTPWWPTPADVSEDYEADAAAWRRGPAGGGPIPPALQRLRAVLLRLHREREQLLQARDCAYHLQSAVRLMKTLSPGSPSGGPSPLPQWCRDLQLHPSQGAVLRIGPGETLEPLLLARPIGLAAQCLEAVIEMQLRALGREPASPGLSSQLAELLFALPAYHTLQRKALSHVPGAARPFPTSRVLRLLTGERGCQVASRLDEALQGSALRDQLRRRCQEEGDLLPGLLGLVGGVAGSASCGLGLGGAGALWSQYWTLLWAACAQSLDLNLGPWRDPRATAQQLSQALGQASLPQECEKELASLCHRLLHQSLIWSWDQGFCQALGSALGGQSSLPTSSGTAELLQQLFPPLLDALREPRLRRIFCQPAGLCTLQTTLLWFLGRAQQYLAAWDPASFLLLIQKDLPPLLHEAEALYSLASEESLALEVEQQLGLEIQKLTAQIQLLPEESLSVFSQECHKQAMQGFKLYMPRGRYWRLRLCPEPPSAPSEYAGLVVRTVLEPVLQGLQGLPPQAQAPALGQALTAIVGAWLDHILTHGIRFSLQGALQLKQDFGVVRELLEEEQWSLSPDLRQTLLMLSIFQQLDGALLCLLQQPLPKSQVHRRPPCCCACQEVQTTKLPSSCLNSLESLEPPLQPGTSPAQTGQLQSTLGGRGPSPEGYLVGNQQAWLALRQHQRPRWHLPFFSCLGTSPES

SEQ ID NO: 18362 - protein, 750 aa, Homo sapiens
  Payload ID: 3665
  Gene Symbol: CCDC142
  Gene Name: coiled-coil domain containing 142
  Uniprot ID: Q17RM4
  ENSP ID: ENSP00000377537
MAQASRSGSLPPLVIVPPLRAQPGGTGEEQWERSRTGGLRWEVHCWPSGTSGGTPWWPTPADVSEDYEADAAAWRRGPAGGGPIPPALQRLRAVLLRLHREREQLLQARDCAYHLQSAVRLMKTLSPGSPSGGPSPLPQWCRDLQLHPSQGAVLRIGPGETLEPLLLARPIGLAAQCLEAVIEMQLRALGREPASPGLSSQLAELLFALPAYHTLQRKALSHVPGAARPFPTSRVLRLLTGERGCQVASRLDEALQGSALRDQLRRRCQEEGDLLPGLLGLVGGVAGSASCGLGLGGAGALWSQYWTLLWAACAQSLDLNLGPWRDPRATAQQLSQALGQASLPQECEKELASLCHRLLHQSLIWSWDQGFCQALGSALGGQSSLPTSSGTAELLQQLFPPLLDALREPRLRRIFCQPADPAPVALGLCTLQTTLLWFLGRAQQYLAAWDPASFLLLIQKDLPPLLHEAEALYSLASEESLALEVEQQLGLEIQKLTAQIQLLPEESLSVFSQECHKQAMQGFKLYMPRGRYWRLRLCPEPPSAPSEYAGLVVRTVLEPVLQGLQGLPPQAQAPALGQALTAIVGAWLDHILTHGIRFSLQGALQLKQDFGVVRELLEEEQWSLSPDLRQTLLMLSIFQQLDGALLCLLQQPLPKSQVHRRPPCCCACQEVQTTKLPSSCLNSLESLEPPLQPGTSPAQTGQLQSTLGGRGPSPEGYLVGNQQAWLALRQHQRPRWHLPFFSCLGTSPES

SEQ ID NO: 18363 - protein, 567 aa, Homo sapiens
  Payload ID: 3665
  Gene Symbol: CCDC142
  Gene Name: coiled-coil domain containing 142
  ENSP ID: ENSP00000415532
  MOD_RES (1)..(1): Any amino acid
XREREQLLQARDCAYHLQSAVRLMKTLSPGSPSGGPSPLPQWCRDLQLHPSQGAVLRIGPGETLEPLLLARPIGLAAQCLEAVIEMQLRALGREPASPGLSSQLAELLFALPAYHTLQRKALSHVPGAARPFPTSRVLRLLTGERGCQVASRLDEALQGSALRDQLRRRCQEEGDLLPGLLGLVGGVAGSASCGLGLGGAGALWSQYWTLLWAACAQSLDLNLGPWRDPRATAQQLSQALGQASLPQECEKELASLCHRLLHQSLIWSWDQGFCQALGSALGGQSSLPTSSGTAELLQQLFPPLLDALREPRLRRIFCQPADPAPVALGLCTLQTTLLWFLGRAQQYLAAWDPASFLLLIQKDLPPLLHEAEALYSLASEESLALEVEQQLGLEIQKLTAQIQLLPEESLSVFSQECHKQAMQGFKLYMPRGRYWRLRLCPEPPSAPSEYAGLVVRTVLEPVLQGLQGLPPQAQAPALGQALTAIVGAWLDHILTHGIRFSLQGALQLKQDFGVVRELLEEEQWSLSPDLRQTLLMLSIFQQLDGALLCLLQQPLPKSQVHRRPPCC

SEQ ID NO: 18364 - protein, 221 aa, Homo sapiens
  Payload ID: 3666
  Gene Symbol: CCDC144NL
  Gene Name: coiled-coil domain containing 144 family, N-terminal like
  Uniprot ID: Q6NUI1
  ENSP ID: ENSP00000328054
MASWGGEKRGGAGGSPKPAVYATRKTPSVGSQEDQWYLDYPGDQWSLGFSYSWWKNSVGSESKHGEGALDQLQHDVRLEDLGELHRAARSGDVPGVEHVLAPGDTGVDKRDRKKSIQQLVPEYKEKQTPESLPQNNNPAAPSQAEGGEGGVACGTVEQMTWLCSLPHAVGGGDGDHSSTGAVGGHPRGPGEYCHLHEQRVHHHIFARGKRKGKNHVSNVVR

SEQ ID NO: 18365 - protein, 571 aa, Homo sapiens
  Payload ID: 3667
  Gene Symbol: CCDC144A
  Gene Name: coiled-coil domain containing 144A
  ENSP ID: ENSP00000344740
MASWGGEKRGGAEGSPKPAVYATRKTPSVGSQGDQWYLGYPGDQWSSGFPYSWWKNSVGSESKHGEGALDQPQHDVRLEDLGELHRAARSGDVPGVEHILAPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEEQDSELTSEEEQERLKGCENKQPQKTSQEPEMAKDCDREDIPIYPVLPHVQKSEEMWIEQGKLEWKNQLKLVINELKQRFGEIYEKYKIPACPEEEPLLDNSTRGTDVKDIPFNLTNNIPGCEEEDASEISVSVVFETFPEQKEPSLKNIIHPYYHPYSGSQEHVCQSSSKFHLHENKLDCDNDNKPGIGHIFSTDKNFHNDASTKKARNPEVVMVEMKEDQEFDLQMTKNMNQNSDSGSTNNYKSLKPKLENLSSLPPDSDRTSEVYLHEELQQDMQKFKNEVNTLEEEFLALKKEDVQLHKDVEEEMEKHRSNSTELSGTLTDGTTVGNDDDGLNQQIPRKENGEHDR

SEQ ID NO: 18366 - protein, 726 aa, Homo sapiens
  Payload ID: 3667
  Gene Symbol: CCDC144A
  Gene Name: coiled-coil domain containing 144A
  ENSP ID: ENSP00000353685
MASWGGEKRGGAEGSPKPAVYATRKTPSVGSQGDQWYLGYPGDQWSSGFPYSWWKNSVGSESKHGEGALDQPQHDVRLEDLGELHRAARSGDVPGVEHILAPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEAEQDSELTSEEEQERLKGCENKQPQKTSQEPEMAKDCDREDIPIYPVLPHVQKSEEMWIEQGKLEWKNQLKLVINELKQRFGEIYEKYKIPACPEEEPLLDNSTRGTDVKDIPFNLTNNIPGCEEEDASEISVSVVFETFPEQKEPSLKNIIHPYYHPYSGSQEHVCQSSSKFHLHENKLDCDNDNKPGIGHIFSTDKNFHNDASTKKARNPEVVMVEMKEDQEFDLQMTKNMNQNSDSGSTNNYKSLKPKLENLSSLPPDSDRTSEVYLHEELQQDMQKFKNEVNTLEEEFLALKKEDVQLHKDVEEEMEKHRSNSTELSGTLTDGTTVGNDDDGLNQQIPRKENGEHDRPADKTSNEKNEVKNQIYPEADFADSMEPSEIASEDCELSHSVYENFMLLIEQLRMEYKDSASLPRIQDTFCLCEHLLKLKNNHCDQLTVKLKQMENMVSVLQNELSETKKTKLQLELQKIEWEKELYDLRFLIGIRKKRISFMKIACCRKKLPC

SEQ ID NO: 18367 - protein, 1427 aa, Homo sapiens
  Payload ID: 3667
  Gene Symbol: CCDC144A
  Gene Name: coiled-coil domain containing 144A
  Uniprot ID: A2RUR9
  ENSP ID: ENSP00000353717
MASWGGEKRGGAEGSPKPAVYATRKTPSVGSQGDQWYLGYPGDQWSSGFPYSWWKNSVGSESKHGEGALDQPQHDVRLEDLGELHRAARSGDVPGVEHILAPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEAEQDSELTSEEEQERLKGCENKQPQKTSQEPEMAKDCDREDIPIYPVLPHVQKSEEMWIEQGKLEWKNQLKLVINELKQRFGEIYEKYKIPACPEEEPLLDNSTRGTDVKDIPFNLTNNIPGCEEEDASEISVSVVFETFPEQKEPSLKNIIHPYYHPYSGSQEHVCQSSSKFHLHENKLDCDNDNKPGIGHIFSTDKNFHNDASTKKARNPEVVMVEMKEDQEFDLQMTKNMNQNSDSGSTNNYKSLKPKLENLSSLPPDSDRTSEVYLHEELQQDMQKFKNEVNTLEEEFLALKKEDVQLHKDVEEEMEKHRSNSTELSGTLTDGTTVGNDDDGLNQQIPRKENGEHDRPADKTSNEKNEVKNQIYPEADFADSMEPSEIASEDCELSHSVYENFMLLIEQLRMEYKDSASLPRIQDTFCLCEHLLKLKNNHCDQLTVKLKQMENMVSVLQNELSETKKTKLQLELQKIEWEKELYDLRLALKQENEEKRNADMLYNKDSEQLRIKEEECGKVVETKQQLKWNLRRLVKELRTVRNNLDLVVQERNDAQKQLSEEQDARILQDQILTSKQKELEMARKKMNSEISHRHQKEKDLFHEDCMLQEEIALLRLEIDTIKNQNKQKEKKYFEDIEAVKEKNDNLQKIIKLNEETLTETILQYSGQLNNLTAENKILNSELENGKQNQERLEIEMESYRCRLAAAVRDCDQSQTARDLKLDFQRTRQEWVRLHDKMKVDMSGLQAKNEILSEKLSNAESKINSLQIQLHNTRDALGRESLILERVQRDLSQTQCQKKETEQMYQIEQSKLKKYIAKQESVEERLSQLQSENMLLRQQLDDAHKKANSQEKTSSTIQDQFHSAAKNLQAESEKQILSLQEKNKELMDEYNHLKERMDQCEKEKAGRKIDLTEAQETVPSRCLHLDAENEVLQLQQTLFSMKAIQKQCETLQKNKKQLKQEVVNLKSYMERNMLERGKAEWHKLLIEERARKEIEEKLNEAILTLQKQAAVSHEQLVQLREDNTTSIKTQMELTIKDLESEISRIKTSQADFNKTELERYKELYLEEVKVRESLSNELSRTNEMIAEVSTQLTVEKEQTRSRSLFTAYATRPVLESPCVGNLNDSEGLNRKHIPRKKRSALKDMESYLLKMQQKLQNDLTAEVAGSSQTGLHRIPQCSSFSSSSLHLLLCSICQPFFLILQLLLNMNLDPI

SEQ ID NO: 18368 - protein, 1425 aa, Homo sapiens
  Payload ID: 3667
  Gene Symbol: CCDC144A
  Gene Name: coiled-coil domain containing 144A
  ENSP ID: ENSP00000382215
MASWGGEKRGGAEGSPKPAVYATRKTPSVGSQGDQWYLGYPGDQWSSGFPYSWWKNSVGSESKHGEGALDQPQHDVRLEDLGELHRAARSGDVPGVEHILAPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEAEQDSELTSEEEQERLKGCENKQPQKTSQEPEMAKDCDREDIPIYPVLPHVQKSEEMWIEQGKLEWKNQLKLVINELKQRFGEIYEKYKIPACPEEEPLLDNSTRGTDVKDIPFNLTNNIPGCEEEDASEISVSVVFETFPEQKEPSLKNIIHPYYHPYSGSQEHVCQSSSKFHLHENKLDCDNDNKPGIGHIFSTDKNFHNDASTKKARNPEVVMVEMKEDQEFDLQMTKNMNQNSDSGSTNNYKSLKPKLENLSSLPPDSDRTSEVYLHEELQQDMQKFKNEVNTLEEEFLALKKEDVQLHKDVEEEMEKHRSNSTELSGTLTDGTTVGNDDDGLNQQIPRKENGEHDRPADKTSNEKNEVKNQIYPEADFADSMEPSEIASEDCELSHSVYENFMLLIEQLRMEYKDSASLPRIQDTFCLCEHLLKLKNNHCDQLTVKLKQMENMVSVLQNELSETKKTKLQLELQKIEWEKELYDLRLALKQENEEKRNADMLYNKDSEQLRIKEEECGKVVETKQQLKWNLRRLVKELRTVRNNLDLVVQERNDAQKQLSEEQDARILQDQILTSKQKELEMARKKMNSEISHRHQKEKDLFHEDCMLQEEIALLRLEIDTIKNQNKQKEKKYFEDIEAVKEKNDNLQKIIKLNEETLTETILQYSGQLNNLTAENKILNSELENGKQNQERLEIEMESYRCRLAAAVRDCDQSQTARDLKLDFQRTRQEWVRLHDKMKVDMSGLQAKNEILSEKLSNAESKINSLQIQLHNTRDALGRESLILERVQRDLSQTQCQKKETEQMYQIEQSKLKKYIAKQESVEERLSQLQSENMLLRQQLDDAHKKANSQEKTSSTIQDQFHSAAKNLQAESEKQILSLQEKNKELMDEYNHLKERMDQCEKEKAGRKIDLTEAQETVPSRCLHLDAENEVLQLQQTLFSMKAIQKQCETLQKNKKQLKQEVVNLKSYMERNMLERGKAEWHKLLIEERARKEIEEKLNEAILTLQKQAAVSHEQLVQLREDNTTSIKTQMELTIKDLESEISRIKTSQADFNKTELERYKELYLEEVKVRESLSNELSRTNEMIAEVSTQLTVEKEQTRSRSLFTAYATRPVLESPCVGNLNDSEGLNRKHIPRKKRSALKDMESYLLKMQQKLQNDLTAEVAAATKYEPGSYIASPLGFTHKENLNQDPVLEVTKEYAQILRRKYIL

SEQ ID NO: 18369 - protein, 178 aa, Homo sapiens
  Payload ID: 3667
  Gene Symbol: CCDC144A
  Gene Name: coiled-coil domain containing 144A
  ENSP ID: ENSP00000398774
  MOD_RES (1)..(1): Any amino acid
XTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEAEQDSELTSEEEQERLKGCENKQPQKTSQEPEMAKDCDREDIPIYPVLPHVQKSEEMWIE

SEQ ID NO: 18370 - protein, 955 aa, Homo sapiens
  Payload ID: 3668
  Gene Symbol: CCDC146
  Gene Name: coiled-coil domain containing 146
  Uniprot ID: Q8IYE0
  ENSP ID: ENSP00000285871
MEDSSTDTEKEEEEEKDEKDQEPIYAIVPTINIQDERFVDLSETPAFIFLHELHAMGKLPGTRMAALKAKYTLLHDAVMSTQESEVQLLQNAKRFTEQIQQQQFHLQQADNFPEAFSTEVSKMREQLLKYQNEYNAVKEREFHNQYRLNSLKEEKIIIVKEFEKITKPGEMEKKMKILRESTEELRKEIMQKKLEIKNLREDLASKQKQLLKEQKELEELLGHQVVLKDEVAHHQTIPVQIGKEIEKITRKKVEMEKKKIVLEQEVKTLNDSLKKVENKVSAIVDEKENVIKEVEGKRALLEIKEREHNQLVKLLELARENEATSLTERGILDLNLRNSLIDKQNYHDELSRKQREKERDFRNLRKMELLLKVSWDALRQTQALHQRLLLEMEAIPKDDSTLSERRRELHKEVEVAKRNLAQQKIISEMESKLVEQQLAEENKLLKEQENMKELVVNLLRMTQIKIDEKEQKSKDFLKAQQKYTNIVKEMKAKDLEIRIHKKKKCEIYRRLREFAKLYDTIRNERNKFVNLLHKAHQKVNEIKERHKMSLNELEILRNSAVSQERKLQNSMLKHANNVTIRESMQNDVRKIVSKLQEMKEKKEAQLNNIDRLANTITMIEEEMVQLRKRYEKAVQHRNESGVQLIEREEEICIFYEKINIQEKMKLNGEIEIHLLEEKIQFLKMKIAEKQRQICVTQKLLPAKRSLDADLAVLQIQFSQCTDRIKDLEKQFVKPDGENRARFLPGKDLTEKEMIQKLDKLELQLAKKEEKLLEKDFIYEQVSRLTDRLCSKTQGCKQDTLLLAKKMNGYQRRIKNATEKMMALVAELSMKQALTIELQKEVREKEDFIFTCNSRIEKGLPLNKEIEKEWLKVLRDEEMHALAIAEKSQEFLEADNRQLPNGVYTTAEQRPNAYIPEADATLPLPKPYGALAPFKPSEPGANMRHIRKPVIKPVEI

SEQ ID NO: 18371 - protein, 170 aa, Homo sapiens
  Payload ID: 3668
  Gene Symbol: CCDC146
  Gene Name: coiled-coil domain containing 146
  ENSP ID: ENSP00000388649
MEDSSTDTEKEEEEEKDEKDQEPIYAIVPTINIQDERFVDLSETPAFIFLHELHAMGKLPGTRMAALKAKYTLLHDAVMSTQESEVQLLQNAKRFTEQIQQQQFHLQQADNFPEAFSTEVSKMREQLLKYQNEYNAVKEREFHNQYRLNSLKEEKIIIVKEFEKITKPGV

SEQ ID NO: 18372 - protein, 591 aa, Homo sapiens
  Payload ID: 3669
  Gene Symbol: CCDC148
  Gene Name: coiled-coil domain containing 148
  Uniprot ID: Q8NFR7
  ENSP ID: ENSP00000283233
MCAASASPDNLVFHMKNEMRNIKYKPVDYQQLRALTEAKKLASASAKLKIRKAMLTSKLSKEQTLIKQHKQVWWQEYQRLNEVRCKMESEIKSLLNEENIGNECLCDLTNFEQELSEQQCTYLKNVINPIQQLRADLKYRQHHTLQHSHPHIEFNSMKVLEEVDFVKKQLKTVFERLRLEQQRIENDLSDWSIKILDHSLEEKTNPLSELPIELESLECPYPDLKSSILSEFYKFTQKYQKKLQDFNLQLEDIYRNCQLSEEDHWIYQAILDQYPGDLFGRRTLYLDMLQRYFPHKSRHDLVEHEKYCDQYRFAIEQQNILISNWNKNKKDFIQKAVLTLTEACATHEMESMLAKDKKKQQELCADLKAKVRQWRAHQEEVARLEMEISARRREKEEEKEKLWKKKELLQRAEKKKKIKKYWAKKKQKWQEMEMRDLQRLEELKKLIAEQSLKDRERVKYRQELLERRLMEKKEVALQEAHEDKERARRLEALRKQVAVVAQFDPVRMMSDTMASKARMGIEIEEEFILQKPLFTLNTYNEQQIISDPRLRFELALREAGLHRTLYAKEILPKISPQKPPRKDMESTVFKI

SEQ ID NO: 18373 - protein, 255 aa, Homo sapiens
  Payload ID: 3669
  Gene Symbol: CCDC148
  Gene Name: coiled-coil domain containing 148
  Uniprot ID: Q8NFR7
  ENSP ID: ENSP00000386583
MCAASASPDNLVFHMKNEMRNIKYKPVDYQQLRALTEAKKLASASAKLKIRKAMLTSKLSKEQTLIKQHKQVWWQEYQRLNEVRCKMESEIKSLLNEENIGNECLCDLTNFEQELSEQQCTYLKNVINPIQQLRADLKYRQHHTLQHSHPHIEFNSMKVLEEVDFVKKQLKTVFERLRLEQQRIENDLSDWSIKILDHSLEEKTNPLSELPIELESLECPYPDLKSSILSEFYKFTQKYQKKLQDFNLQLEDIYR

SEQ ID NO: 18374 - protein, 600 aa, Homo sapiens
  Payload ID: 3669
  Gene Symbol: CCDC148
  Gene Name: coiled-coil domain containing 148
  ENSP ID: ENSP00000386674
MNQRDQPFMTIQRNDSSDNLVFHMKNEMRNIKYKPVDYQQLRALTEAKKLASASAKLKIRKAMLTSKLSKEQTLIKQHKQVWWQEYQRLNEVRCKMESEIKSLLNEENIGNECLCDLTNFEQELSEQQCTYLKNVINPIQQLRADLKYRQHHTLQHSHPHIEFNSMKVLEEVDFVKKQLKTVFERLRLEQQRIENDLSDWSIKILDHSLEEKTNPLSELPIELESLECPYPDLKSSILSEFYKFTQKYQKKLQDFNLQLEDIYRNCQLSEEDHWIYQAILDQYPGDLFGRRTLYLDMLQRYFPHKSRHDLVEHEKYCDQYRFAIEQQNILISNWNKNKKDFIQKAVLTLTEACATHEMESMLAKDKKKQQELCADLKAKVRQWRAHQEEVARLEMEISARRREKEEEKEKLWKKKELLQRAEKKKKIKKYWAKKKQKWQEMEMRDLQRLEELKKLIAEQSLKDRERVKYRQELLERRLMEKKEVALQEAHEDKERARRLEALRKQVAVVAQFDPVRMMSDTMASKARMGIEIEEEFILQKPLFTLNTYNEQQIISDPRLRFELALREAGLHRTLYAKEILPKISPQKPPRKDMESTVFKI

SEQ ID NO: 18375 - protein, 54 aa, Homo sapiens
  Payload ID: 3669
  Gene Symbol: CCDC148
  Gene Name: coiled-coil domain containing 148
  ENSP ID: ENSP00000398372
MCAASASPDNLVFHMKNEMRNIKYKPVDYQQLRALTEAKKLASASAKLKKLSTK

SEQ ID NO: 18376 - protein, 15 aa, Homo sapiens
  Payload ID: 3669
  Gene Symbol: CCDC148
  Gene Name: coiled-coil domain containing 148
  ENSP ID: ENSP00000400751
MCAASASPDVKWNLK

SEQ ID NO: 18377 - protein, 40 aa, Homo sapiens
  Payload ID: 3669
  Gene Symbol: CCDC148
  Gene Name: coiled-coil domain containing 148
  ENSP ID: ENSP00000415343
MCAASASPDQKSNVDFKVIQRTNTNKTTQASVVAGIPEAE

SEQ ID NO: 18378 - protein, 50 aa, Homo sapiens
  Payload ID: 3669
  Gene Symbol: CCDC148
  Gene Name: coiled-coil domain containing 148
  ENSP ID: ENSP00000415540
MCAASASPDNLVFHMKNEMRNIKYKPVDYQQLRALTEAKKLASASAKLKM

SEQ ID NO: 18379 - protein, 529 aa, Homo sapiens
  Payload ID: 3670
  Gene Symbol: CCDC149
  Gene Name: coiled-coil domain containing 149
  Uniprot ID: Q6ZUS6
  ENSP ID: ENSP00000374260
MVVIVVVIIIIIARAATWDSEYLVCKRKLESKKEALLILSKELDTCQQERDQYKLMANQLRERHQSLKKKYRELIDGDPSLPPEKRKQANLAQLLRDSQDRNKHLGEEIKELQQRLGEVQGDNKLLRMTIAKQRLGDEAIGVRHFAAHEREDLVQQLERAKEQIESLEHDLQASVDELQDVKEERSSYQDKVERLNQELNHILSGHENRIIDVDALCMENRYLQERLKQLHEEVNLLKSNIAKYKNALERRKNSKGQGKSSSSALTGVLSAKQVQDLLSEDHGCSLPATPQSISDLKSLATALLETIHEKNMVIQHQRQTNKILGNRVAELEKKLRTLEVSGLWSLPGGKDTILFSDPTLPSGQRSRSPLLKFVEQPTENKADPKDGEAQKQEEDESCAAAEALTAPEDAGRPAVNSPANQSRGNQCKLFHPSLPQLPSEEEVNSLGREIIKLTKEQAAAELEEVRRESPIEGQRSETGPAPPGLAIQGELPKSHLDSFEASRPAAKASTPEDGKGIPEGGGMRSTVKT

SEQ ID NO: 18380 - protein, 529 aa, Homo sapiens
  Payload ID: 3670
  Gene Symbol: CCDC149
  Gene Name: coiled-coil domain containing 149
  Uniprot ID: Q6ZUS6
  ENSP ID: ENSP00000425715
MEEEAMNGDRTESDWQGLVSEYLVCKRKLESKKEALLILSKELDTCQQERDQYKLMANQLRERHQSLKKKYRELIDGDPSLPPEKRKQANLAQLLRDSQDRNKHLGEEIKELQQRLGEVQGDNKLLRMTIAKQRLGDEAIGVRHFAAHEREDLVQQLERAKEQIESLEHDLQASVDELQDVKEERSSYQDKVERLNQELNHILSGHENRIIDVDALCMENRYLQERLKQLHEEVNLLKSNIAKYKNALERRKNSKGQGKSSSSALTGVLSAKQVQDLLSEDHGCSLPATPQSISDLKSLATALLETIHEKNMVIQHQRQTNKILGNRVAELEKKLRTLEVSGLWSLPGGKDTILFSDPTLPSGQRSRSPLLKFVEQPTENKADPKDGEAQKQEEDESCAAAEALTAPEDAGRPAVNSPANQSRGNQCKLFHPSLPQLPSEEEVNSLGREIIKLTKEQAAAELEEVRRESPIEGQRSETGPAPPGLAIQGELPKSHLDSFEASRPAAKASTPEDGKGIPEGGGMRSTVKT

SEQ ID NO: 18381 - protein, 141 aa, Homo sapiens
  Payload ID: 3670
  Gene Symbol: CCDC149
  Gene Name: coiled-coil domain containing 149
  Uniprot ID: Q6ZUS6
  ENSP ID: ENSP00000427529
MEEEAMNGDRTESDWQGLVSEYLVCKRKLESKKEALLILSKELDTCQQERDQYKLMANQLRERHQSLKKKYRELIDGDPSLPPEKRKQANLAQLLRDSQDRNKHLGEEIKELQQRLGEVQGDNKGRLRSKKKMKVVPLLRR

SEQ ID NO: 18382 - protein, 540 aa, Homo sapiens
  Payload ID: 3670
  Gene Symbol: CCDC149
  Gene Name: coiled-coil domain containing 149
  ENSP ID: ENSP00000488929
MEEEAMNGDRTESDWQGLVSEYLVCKRKLESKKEALLILSKELDTCQQERDQYKLMANQLRERHQSLKKKYRELIDGDPSLPPEKRKQANLAQLLRDSQDRNKHLGEEIKELQQRLGEVQGDNKLLRMTIAKQRLGDEAIGVRHFAAHEREDLVQQLERAKEQIESLEHDLQASVDELQDVKEERSSYQDKVERLNQELNHILSGHENRIIDVDALCMENRYLQERLKQLHEEVNLLKSNIAKYKNALERRKNSKGQGKSSSSALTGVLSAKQVQDLLSEDHGCSLPATPQSISDLKSLATALLETIHEKNMVIQHQRQTNKILGNRVAELEKKLRTLEVSGLWSLPGLSYNVSVGFGRGKDTILFSDPTLPSGQRSRSPLLKFVEQPTENKADPKDGEAQKQEEDESCAAAEALTAPEDAGRPAVNSPANQSRGNQCKLFHPSLPQLPSEEEVNSLGREIIKLTKEQAAAELEEVRRESPIEGQRSETGPAPPGLAIQGELPKSHLDSFEASRPAAKASTPEDGKGIPEGGGMRSTVKT

SEQ ID NO: 18383 - protein, 951 aa, Homo sapiens
  Payload ID: 3671
  Gene Symbol: CCDC15
  Gene Name: coiled-coil domain containing 15
  Uniprot ID: Q0P6D6
  ENSP ID: ENSP00000341684
MLGSMARKKPRNTSRLPLALNPLKSKDVLAVLAERNEAIVPVGAWVEPASPGSSEIPAYTSAYLIEEELKEQLRKKQEALKHFQKQVKYRVNQQIRLRKKQQLQKSYERAQKEGSIAMQSSATHLTSKRTSVFPNNLNVAIGSSRLPPSLMPGDGIEDEENQNELFQQQAQALSETMKQARHRLASFKTVIKKKGSVFPDDGRKSFLTREEVLSRKPASTGINTGIRGELPIKVHQGLLAAVPYQNYMENQELDYEEPDYEESSSLVTDEKGKEDLFGRGQQDQQAIHSEDKNKPFSRVQKVKFKNPLFVLMEEEEQKQLHFEGLQDILPEAQDYFLEAQGDLLETQGDLTGIQSVKPDTQAVEMKVQVTEPEGQAIEPEGQPIKTETQGIMLKAQSIELEEGSIVLKTQDFLPTNQALLTKNQDVLLKDHCVLPKDQSILLKYQDQDFLPRDQHVLHKDQDILPKYQDQNFLPKDQNFLSRDQHVLPKDQDILPKYQDQNFLPKDQNFLSRDQHVLPKDQNILPKYQGQDFLPKDQDFLSRDQHVLPKDWNILPKCQDQDFLPRDQGVLPKDQNILPICQDQDFLPRDQGYLPKDQNILPICQDRDFLPRDLHVLSNDQNILPKCQDQDFLPKYQKVHFKEPYSDMTDEKGREDFSLADYQCLPPKSQDQDDIKNQQPASFMREERVREELPLDYHQYVVPKIQDQDSPREQNKHIKLPSSFEKWEIARGNTPGVPLAYDRYQSGLSTEFQAPLAFQSDVDKEEDKKERQKQYLRHRRLFMDIEREQVKEQQRQKEQKKKIEKIKKKREQECYAAEQRILRMNFHEDPYSGEKLSEILAQLQLQEIKGTREKQQREKEYLRYVEALRAQIQEKMQLYNITLPPLCCCGPDFWDAHPDTCANNCIFYKNHRAYTRALHSFINSCDVPGGNSTLRVAIHNFASAHRRTLKNL

SEQ ID NO: 18384 - protein, 962 aa, Homo sapiens
  Payload ID: 3671
  Gene Symbol: CCDC15
  Gene Name: coiled-coil domain containing 15
  ENSP ID: ENSP00000435403
MLGSMARKKPRNTSRLPLALNPLKSKDVLAVLAERNEAIVPVGAWVEPASPGSSEIPAYTSAYLIEEELKEQLRKKQEALKHFQKQVKYRVNQQIRLRKKQQLQKSYERAQKEGSIAMQSSATHLTSKRTSVFPNNLNVAIGSSRLPPSLMPGDGIEDEENQNELFQQQAQALSETMKQARHRLASFKTVIKKKGSVFPDDGRKSFLTREEVLSRKPASTGINTGIRGELPIKVHQGLLAAVPYQNYMENQELDYEEPDYEESSSLVTDEKGKEDLFGRGQQDQQAIHSEDKNKPFSRVQKVKFKNPLFVLMEEEEQKQLHFEGLQDILPEAQDYFLEAQGDLLETQGDLTGIQSVKPDTQAVEMKVQVTEPEGQAIEPEGQPIKTETQGIMLKAQSIELEEGSIVLKTQDFLPTNQALLTKNQDVLLKDHCVLPKDQSILLKYQDQDFLPRDQHVLHKDQDILPKYQDQNFLPKDQNFLSRDQHVLPKDQDILPKYQDQNFLPKDQNFLSRDQHVLPKDQNILPKYQGQDFLPKDQDFLSRDQHVLPKDWNILPKCQDQDFLPRDQGVLPKDQNILPICQDQDFLPRDQGYLPKDQNILPICQDRDFLPRDLHVLSNDQNILPKCQDQDFLPKYQKVHFKEPYSDMTDEKGREDFSLADYQCLPPKSQDQDDIKNQQPASFMREERVREELPLDYHQYVVPKIQDQDSPREQNKHIKLPSSFEKWEIARGNTPGVPLAYDRYQSGLSTEFQAPLAFQSDVDKEEDKKERQKQYLRHRRLFMDIEREQVKEQQRQKEQKKKIEKIKKKREQECYAAEQRILRMNFHEDPYSGEKLSEILAQLQLQEIKGTREKQQREKEYLSSLCLIILYLYRYVEALRAQIQEKMQLYNITLPPLCCCGPDFWDAHPDTCANNCIFYKNHRAYTRALHSFINSCDVPGGNSTLRVAIHNFASAHRRTLKNL

SEQ ID NO: 18385 - protein, 1101 aa, Homo sapiens
  Payload ID: 3672
  Gene Symbol: CCDC150
  Gene Name: coiled-coil domain containing 150
  Uniprot ID: Q8NCX0
  ENSP ID: ENSP00000373827
MDCKVHMETTVSRPVLSPTHINATASETFTVLQQRMRIVEEQTSSLRDDLIMLDFGEKRGYLEAPDCLEDLDSQKVISPIQNEAICAGKTDILWKNCEFLVNRMCRLESLMQSLKMNIFRLQTEKDLNPQKTAFLKDRLNAIQEEHSKDLKLLHLEVMNLRQQLRAVKEEEDKAQDEVQRLTATLKIASQTKKNAAIIEEELKTTKRKMNLKIQELRRQLAQEKYLRESLEKSASAMLLKIQEMGSTVEVERKQVHILQQNCIALRDSIQSAQELLAQEQKKKEELEIATSQLKSDLTSRDDLISKLVEENKNLQISFNKEHEENAYLRSEIMSLHEASEKAQVLNDQLTKKCSELSCMLQTVTMEKARIIADHQAILQVEQKMMTQTFQEQNLLLDAAHASITNELQTVQNEKTQLQAHLDHLILEHNQCIQKAQDAEKRTAVQKELLESTIARLRGELEASMQEKKSLLEEKERFQREVNKTEKEIVQERCNLEKELAKNKVDINTLTHNLQTLEEENKHLADQMASLELQQVTSDYHGLAQQKVEKITESKNKLAYENGKLQIKVKQLEEQVQSFTDTSLQNDHLRKMNKYLQTKYAQANSELSAKRVHLQQADAHLKEVKSILERSKEELSRTVKCRNAALKESQKLKEDLEAVEDRENKKVGNFQRQLAEAKEDNCKVTIMLENVLASHSKMQGALEKVQIELGRRDSEIAGLKKERDLNQQRVQKLEAEVDQWQARMLVMEDQHNSEIESLQKALGVAREDNRKLAMSLEQALQTNNHLQTKLDHIQEQLESKELERQNLETFKDRMTEESKVEAELHAERIEALRKQFQTERETTKKVAQREVAELKKALDEANFRSVEVSRTNRELRQKLAELEKILESNKEKIKNQKTQIKLHLSAKANNAQNIERMKQIEKELKQMELIKDQYQKKNYEQSLSIQRFVCEMTNLQKEMQMLAKSQYDASVRNKQQELHLEAERKIRQELENRCQELEETVRHLKKCKEATENTLKEASVESEQITANLEEAHRWFKHRFDGLQLELTKNRLQRPSGEDRWQEKDQDVKHDVMSNQSVLHRWERKQNLRPMPKKYHSEVQRK

SEQ ID NO: 18386 - protein, 588 aa, Homo sapiens
  Payload ID: 3672
  Gene Symbol: CCDC150
  Gene Name: coiled-coil domain containing 150
  ENSP ID: ENSP00000387257
MPLRKRKSPERTASSKSPEISRSHVNSIKERTSSVGLPSVIPNSTRRVSFAPNLPSMKTSQDIGDSRISLKTLLNAIKTMEGRLEGKIEILASRPLINDESPNFLKQDSVKSILERSKEELSRTVKCRNAALKESQKLKEDLEAVEDRENKKVGNFQRQLAEAKEDNCKVTIMLENVLASHSKMQGALEKVQIELGRRDSEIAGLKKERDLNQQRVQKLEAEVDQWQARMLVMEDQHNSEIESLQKALGVAREDNRKLAMSLEQALQTNNHLQTKLDHIQEQLESKELERQNLETFKDRMTEESKVEAELHAERIEALRKQFQTERETTKKVAQREVAELKKALDEANFRSVEVSRTNRELRQKLAELEKILESNKEKIKNQKTQIKLHLSAKANNAQNIERMKQIEKELKQMELIKDQYQKKNYEQSLSIQRFVCEMTNLQKEMQMLAKSQYDASVRNKQQELHLEAERKIRQELENRCQELEETVRHLKKCKEATENTLKEASVESEQITANLEEAHRWFKHRFDGLQLELTKNRLQRPSGEDRWQEKDQDVKHDVMSNQSVLHRWERKQNLRPMPKKYHSEVQRK

SEQ ID NO: 18387 - protein, 68 aa, Homo sapiens
  Payload ID: 3672
  Gene Symbol: CCDC150
  Gene Name: coiled-coil domain containing 150
  ENSP ID: ENSP00000389008
MDCKVHMETTVSRPVLSPTHINATASETFTVLQQRMRIVEEQTSSLRDDLIMLDFGEKRRMQPLLKRN

SEQ ID NO: 18388 - protein, 182 aa, Homo sapiens
  Payload ID: 3672
  Gene Symbol: CCDC150
  Gene Name: coiled-coil domain containing 150
  ENSP ID: ENSP00000396153
MPLRKRKSPERTASSKSPEISRSHVNSIKERTSSVGLPSVIPNSTRRVSFAPNLPSMKTSQDIGDSRISLKTLLNAIKTMEGRLEGKIEILASRPLINDESPNFLKQDSVKSILERSKEELSRTVKCRNAALKESQKLKEDLEAVEDRENKKVGNFQRQLAEAKEDNCKVTIMLENVLASHS

SEQ ID NO: 18389 - protein, 417 aa, Homo sapiens
  Payload ID: 3672
  Gene Symbol: CCDC150
  Gene Name: coiled-coil domain containing 150
  Uniprot ID: Q8NCX0
  ENSP ID: ENSP00000413957
MPLRKRKSPERTASSKSPEISRSHVNSIKERTSSVGLPSVIPNSTRRVSFAPNLPSMKTSQDIGDSRISLKTLLNAIKTMEGRLEGKIEILASRPLINDESPNFLKQDSVKSILERSKEELSRTVKCRNAALKESQKLKEDLEAVEDRENKKVGNFQRQLAEAKEDNCKVTIMLENVLASHSKMQGALEKVQIELGRRDSEIAGLKKERDLNQQRVQKLEAEVDQWQARMLVMEDQHNSEIESLQKALGVAREDNRKLAMSLEQALQTNNHLQTKLDHIQEQLESKELERQNLETFKDRMTEESKVEAELHAERIEALRKQFQTERETTKKVAQREVAELKKALDEANFRSVEVSRTNRELRQKLAELEKILESNKEKIKNQKTQIKLHLSAKANNAQNIERMKVVWETSSHFLDTL

SEQ ID NO: 18390 - protein, 595 aa, Homo sapiens
  Payload ID: 3673
  Gene Symbol: CCDC151
  Gene Name: coiled-coil domain containing 151
  Uniprot ID: A5D8V7
  ENSP ID: ENSP00000348757
MTSPLCRAASANALPPQDQASTPSSRVKGREASGKPSHLRGKGTAQAWTPGRSKGGSFHRGAGKPSVHSQVAELHKKIQLLEGDRKAFFESSQWNIKKNQETISQLRKETKALELKLLDLLKGDEKVVQAVIREWKWEKPYLKNRTGQALEHLDHRLREKVKQQNALRHQVVLRQRRLEELQLQHSLRLLEMAEAQNRHTEVAKTMRNLENRLEKAQMKAQEAEHITSVYLQLKAYLMDESLNLENRLDSMEAEVVRTKHELEALHVVNQEALNARDIAKNQLQYLEETLVRERKKRERYISECKKRAEEKKLENERMERKTHREHLLLQSDDTIQDSLHAKEEELRQRWSMYQMEVIFGKVKDATGTDETHSLVRRFLAQGDTFAQLETLKSENEQTLVRLKQEKQQLQRELEDLKYSGEATLVSQQKLQAEAQERLKKEERRHAEAKDQLERALRAMQVAKDSLEHLASKLIHITVEDGRFAGKELDPQADNYVPNLLGLVEEKLLKLQAQLQGHDVQEMLCHIANREFLASLEGRLPEYNTRIALPLATSKDKFFDEESEEEDNEVVTRASLKIRSQKLIESHKKHRRSRRS

SEQ ID NO: 18391 - protein, 535 aa, Homo sapiens
  Payload ID: 3673
  Gene Symbol: CCDC151
  Gene Name: coiled-coil domain containing 151
  ENSP ID: ENSP00000466800
MTSPLCRAASANALPPQDQASTPSSRVKGREASGKPSHLRGKGTAQAWTPGRSKGGSFHRGAGKPSVHSQVAELHKKIQLLEGDRKAFFESSQWNIKKNQETISQLRKETKALELKLLDLLKALEHLDHRLREKVKQQNALRHQVVLRQRRLEELQLQHSLRLLEMAEAQNRHTEVAKDESLNLENRLDSMEAEVVRTKHELEALHVVNQEALNARDIAKNQLQYLEETLVRERKKRERYISECKKRAEEKKLENERMERKTHREHLLLQSDDTIQDSLHAKEEELRQRWSMYQMEVIFGKVKDATGTDETHSLVRRFLAQGDTFAQLETLKSENEQTLVRLKQEKQQLQRELEDLKYSGEATLVSQQKLQAEAQERLKKEERRHAEAKDQLERALRAMQVAKDSLEHLASKLIHITVEDGRFAGKELDPQADNYVPNLLGLVEEKLLKLQAQLQGHDVQEMLCHIANREFLASLEGRLPEYNTRIALPLATSKDKFFDEESEEEDNEVVTRASLKIRSQKLIESHKKHRRSRRS

SEQ ID NO: 18392 - protein, 115 aa, Homo sapiens
  Payload ID: 3673
  Gene Symbol: CCDC151
  Gene Name: coiled-coil domain containing 151
  ENSP ID: ENSP00000467313
MTSPLCRAASANALPPQDQASTPSSRVKGREASGKPSHLRGKGTAQAWTPGRSKGGSFHRGAGKPSVHSQVAELHKKIQLLESHSVARWECSGTISAHCNLRLPESLEPGRRRLW

SEQ ID NO: 18393 - protein, 404 aa, Homo sapiens
  Payload ID: 3673
  Gene Symbol: CCDC151
  Gene Name: coiled-coil domain containing 151
  ENSP ID: ENSP00000467429
MAEAQNRHTEVAKTMRNLENRLEKAQMKAQEAEHITSVYLQLKAYLMDESLNLENRLDSMEAEVVRTKHELEALHVVNQEALNARDIAKNQLQYLEETLVRERKKRERYISECKKRAEEKKLENERMERKTHREHLLLQSDDTIQDSLHAKEEELRQRWSMYQMEVIFGKVKDATGTDETHSLVRRFLAQGDTFAQLETLKSENEQTLVRLKQEKQQLQRELEDLKYSGEATLVSQQKLQAEAQERLKKEERRHAEAKDQLERALRAMQVAKDSLEHLASKLIHITVEDGRFAGKELDPQADNYVPNLLGLVEEKLLKLQAQLQGHDVQEMLCHIANREFLASLEGRLPEYNTRIALPLATSKDKFFDEESEEEDNEVVTRASLKIRSQKLIESHKKHRRSRRS

SEQ ID NO: 18394 - protein, 254 aa, Homo sapiens
  Payload ID: 3674
  Gene Symbol: CCDC152
  Gene Name: coiled-coil domain containing 152
  Uniprot ID: Q4G0S7
  ENSP ID: ENSP00000354888
MDQSSEGCMKKISSVNLDKLINDFSQIEKKMVETNGKNNILDIQLEKSNCLLKVMQAKEVSIKEECATLHNIIKGLQQTIEYQQNLKGENEQLKISADLIKEKLKSHEQEYKNNIAKLVSEMKIKEEGYKKEISKLYQDMQRKVELNEEKHKELIEKKEMEISELNAKLRSQEKEKQNEIIKLQLEFDAKLARVQTKSKSYQDSTVLPQSIYRRKLQHFQEEKNKEIAILRNTIRDLEQRLSVGKDSHLKRRRF

SEQ ID NO: 18395 - protein, 198 aa, Homo sapiens
  Payload ID: 3674
  Gene Symbol: CCDC152
  Gene Name: coiled-coil domain containing 152
  Uniprot ID: Q4G0S7
  ENSP ID: ENSP00000373479
MDQSSEGCMKKISSVNLDKLINDFSQIEKKMVETNGKNNILDIQLEKSNCLLKVMQAKEVSIKEECATLHNIIKGLQQTIEYQQNLKVELNEEKHKELIEKKEMEISELNAKLRSQEKEKQNEIIKLQLEFDAKLARVQTKSKSYQDSTVLPQSIYRRKLQHFQEEKNKEIAILRNTIRDLEQRLSVGKDSHLKRRRF

SEQ ID NO: 18396 - protein, 210 aa, Homo sapiens
  Payload ID: 3675
  Gene Symbol: CCDC153
  Gene Name: coiled-coil domain containing 153
  Uniprot ID: Q494R4
  ENSP ID: ENSP00000423567
MPPKNKEKGKKSGAQKKKKNWGADVVAESRHRLVVLEKELLRDHLALRRDEARRAKASEDQLRQRLQGVEAELEGARSEGKAIYAEMSRQCHALQEDMQTRSKQLEEEVKGLRGQLEACQREAAAAREEAEQALGERDQALAQLRAHMADMEAKYEEILHDSLDRLLAKLRAIKQQWDGAALRLHARHKEQQRQFGLTPPGSLRPPAPSL

SEQ ID NO: 18397 - protein, 210 aa, Homo sapiens; identical to SEQ ID NO: 18396
  Payload ID: 3675
  Gene Symbol: CCDC153
  Gene Name: coiled-coil domain containing 153
  Uniprot ID: Q494R4
  ENSP ID: ENSP00000445431

SEQ ID NO: 18398 - protein, 674 aa, Homo sapiens
  Payload ID: 3676
  Gene Symbol: CCDC154
  Gene Name: coiled-coil domain containing 154
  Uniprot ID: A6NI56
  ENSP ID: ENSP00000373828
MSELADSGPSGASAPSQLRAVTLEDLGLLLAGGLASPEPLSLEELSERYESSHPTSTASVPEQDTAKHWNQLEQWVVELQAEVACLREHKQRCERATRSLLRELLQVRARVQLQGSELRQLQQEARPAAQAPEKEAPEFSGLQNQMQALDKRLVEVREALTRLRRRQVQQEAERRGAEQEAGLRLAKLTDLLQQEEQGREVACGALQKNQEDSSRRVDLEVARMQAQVTKLGEEVSLRFLKREAKLCGFLQKSFLALEKRMKASESSRLKLEGSLRGELESRWEKLRGLMEERLRALQGQHEVGPGGRRAEESHLLEQCQGLDAAVAQLTKFVQQNQASLNRVLLAEEKAWDAKGRLEESRAGELAAYVQENLEAAQLAGELARQEMHGELVLLREKSRALEASVAQLAGQLKELSGHLPALSSRLDLQEQMLGLRLSEAKTEWEGAERKSLEDLARWRKEVTEHLRGVREKVDGLPQQIESVSDKCLLHKSDSDLRISAEGKAREFKVGALRQELATLLSSVQLLKEDNPGRKIAEMQGKLATNQIMKLENCVQANKTIQNLRFNTEARLRTQEMATLWESVLRLWSEEGPRTPLGSWKALPSLVRPRVFIKDMAPGKVVPMNCWGVYQAVRWLRWKASLIKLRALRRPGGVLEKPHSQEQVQQLTPSLFIQK

SEQ ID NO: 18399 - protein, 522 aa, Homo sapiens
  Payload ID: 3676
  Gene Symbol: CCDC154
  Gene Name: coiled-coil domain containing 154
  ENSP ID: ENSP00000386744
MQALDKRLVEVREALTRLRRRQVQQEAERRGAEQEAGLRLAKLTDLLQQEEQGREVACGALQKNQEDSSRRVDLEVARMQAQVTKLGEEVSLRFLKREAKLCGFLQKSFLALEKRMKASESSRLKLEGSLRGELESRWEKLRGLMEERLRALQGQHEESHLLEQCQGLDAAVAQLTKFVQQNQASLNRVLLAEEKAWDAKGRLEESRAGELAAYVQENLEAAQLAGELARQEMHGELVLLREKSRALEASVAQLAGQLKELSGHLPALSSRLDLQEQMLGLRLSEAKTEWEGAERKSLEDLARWRKEVTEHLRGVREKVDGLPQQIESVSDKCLLHKSDSDLRISAEGKAREFKVGALRQELATLLSSVQLLKEDNPGRKIAEMQGKLATFQNQIMKLENCVQANKTIQNLRFNTEARLRTQEMATLWESVLRLWSEEGPRTPLGSWKALPSLVRPRVFIKDMAPGKVVPMNCWGVYQAVRWLRWKASLIKLRALRRPGGVLEKPHSQEQVQQLTPSLFIQK

SEQ ID NO: 18400 - protein, 99 aa, Homo sapiens
  Payload ID: 3676
  Gene Symbol: CCDC154
  Gene Name: coiled-coil domain containing 154
  ENSP ID: ENSP00000456484
QLKELSGHLPALSSRLDLQEQMLGLRLSEAKTEWEGAERKSLEDLARWRKEVTEHLRGVREKVDGLPQQIESVSDKCLLHKSDSDLRISAEGKASFRTK

SEQ ID NO: 18401 - protein, 562 aa, Homo sapiens
  Payload ID: 3677
  Gene Symbol: CCDC155
  Gene Name: coiled-coil domain containing 155
  Uniprot ID: Q8N6L0
  ENSP ID: ENSP00000404220
MDLPEGPVGGPTAEMYLRERPEEARLGMPVSLEEQILNSTFEACDPQRTGTVAVAQVLAYLEAVTGQGPQDARLQTLANSLDPNGEGPKATVDLDTFLVVMRDWIAACQLHGGLELEEETAFQGALTSRQLPSGCPEAEEPANLESFGGEDPRPELQATADLLSSLEDLELSNRRLVGENAKLQRSMETAEEGSARLGEEILALRKQLHSTQQALQFAKAMDEELEDLKTLARSLEEQNRSLLAQARQAEKEQQHLVAEMETLQEENGKLLAERDGVKKRSQELAMEKDTLKRQLFECEHLICQRDTILSERTRDVESLAQTLEEYRVTTQELRLEISRLEEQLSQTYEGPDELPEGAQLRRVGWTELLPPSLGLEIEAIRQKQEVATADLSNPLCGVWQWEEVIHETSEETEFPSEAPAGGQRNFQGEPAHPEEGRKEPSMWLTRREEEEDAESQVTADLPVPLGAPRPGDIPENPPERPARRELQQALVPVMKKLVPVRRRAWGQLCLPPQRLRVTRHPLIPAPVLGLLLLLLLSVLLLGPSPPPTWPHLQLCYLQPPPV

SEQ ID NO: 18402 - protein, 75 aa, Homo sapiens
  Payload ID: 3677
  Gene Symbol: CCDC155
  Gene Name: coiled-coil domain containing 155
  ENSP ID: ENSP00000468838
MPVSLEEQILNSTFEACDPQRTGTVAVAQVLAYLEAVTGQGPQDARLQTLANSLDPNGEGPKATVDLDTFLVVMR

SEQ ID NO: 18403 - protein, 91 aa, Homo sapiens
  Payload ID: 3677
  Gene Symbol: CCDC155
  Gene Name: coiled-coil domain containing 155
  ENSP ID: ENSP00000469367
MPVSLEEQILNSTFEACDPQRTGTVAVAQVLAYLEAVTGQGPQDARLQTLANSLDPNGEGPKATVDLDTFLVVMRDWIAACQLHGGLELEE

SEQ ID NO: 18404 - protein, 193 aa, Homo sapiens
  Payload ID: 3677
  Gene Symbol: CCDC155
  Gene Name: coiled-coil domain containing 155
  ENSP ID: ENSP00000469435
MDLPEGPVGGPTAEMYLRERPEEARLGMPVSLEEQILNSTFEACDPQRTGTVAVAQVLAYLEAVTGQGPQDARLQTLANSLDPNGEGPKATVDLDTFLVVMRDWIAACQLHGGLELEEETAFQGALTSRQLPSGCPEAEEPANLESFGGEDPRPELQATADLLSSLEDLELSNRRLVGENAKLQRSMETAEEG

SEQ ID NO: 18405 - protein, 42 aa, Homo sapiens
  Payload ID: 3677
  Gene Symbol: CCDC155
  Gene Name: coiled-coil domain containing 155
  ENSP ID: ENSP00000470765
MDLPEGPVGGPTAESAPEGETALLAGTPEQLLTHCGSSLTVE

SEQ ID NO: 18406 - protein, 524 aa, Homo sapiens
  Payload ID: 3677
  Gene Symbol: CCDC155
  Gene Name: coiled-coil domain containing 155
  ENSP ID: ENSP00000470819
  MOD_RES (1)..(1): Any amino acid
XNSTFEACDPQRTGTVAVAQVLAYLEAVTGQGPQDARLQTLANSLDPNGEGPKATVDLDTFLVVMRDWIAACQLHGGLELEEETAFQGALTSRQLPSGCPEAEEPANLESFGGEDPRPELQATADLLSSLEDLELSNRRLVGENAKLQRSMETAEEGSARLGEEILALRKQLHSTQQALQFAKAMDEELEDLKTLARSLEEQNRSLLAQARQAEKEQQHLVAEMETLQEENGKLLAERDGVKKRSQELAMEKDTLKRQLFECEHLICQRDTILSERTRDVESLAQTLEEYRVTTQELRLEISRLEEQLSQTYEGPDELPEGAQLRRVGWTELLPPSLGLEIEAIRQEVATADLSNPLCGVWQWEEVIHETSEETEFPSEAPAGGQRNFQGEPAHPEEGRKEPSMWLTRREEEEDAESQVTADLPVPLGAPRPGDIPENPPERPARRELQQALVPVMKKLVPVRRRAWGQLCLPPQRLRVTRHPLIPAPVLGLLLLLLLSVLLLGPSPPPTWPHLQLCYLQPPPV

SEQ ID NO: 18407 - protein, 188 aa, Homo sapiens
  Payload ID: 3677
  Gene Symbol: CCDC155
  Gene Name: coiled-coil domain containing 155
  ENSP ID: ENSP00000471777
MYLRERPEEARLGMPVSLEEQILNSTFEACDPQRTGTVAVAQVLAYLEAVTGQGPQDARLQTLANSLDPNGEGPKATVDLDTFLVVMRDWIAACQLHGGLELEEETAFQGALTSRQLPSGCPEAEEPANLESFGGEDPRPELQATADLLSSLEDLELSNRRLVGENAKLQRSMETAEEGSARLGEEIL

SEQ ID NO: 18408 - protein, 752 aa, Homo sapiens
  Payload ID: 3678
  Gene Symbol: CCDC157
  Gene Name: coiled-coil domain containing 157
  Uniprot ID: Q569K6
  ENSP ID: ENSP00000343087
MAHLLGSQACMESLRTDLTDLQGAIVDVFSRAGPVRFPSWKFPDRMACDLDMVALLEHYDHVPGDPEFTQLSHAVLLELVIDRLLLLLQSCMSYLENLGSEQMMPPAQAAGPCMSVGLTVRRFWDSLLRLGTLHQQPLPQKGANQRETPTSKPTTKGEPARSPEYLTTKLIKPSSPVLGLPQTCQEPESIPVRASLQFPATTFKNTRSVHSQTIETALVPCDACASVQGSLQKVGKVVISLCQSQNLPSSLGQFQQLVQDSMGLRPLPAATVGRWAAEQRKDLTRLSKHVEALRAQLEEAEGQKDGLRKQAGKLEQALKQEQGARRRQAEEDEQCLSEWEHDKQQLLTETSDLKTKMATLERELKQQRESTQAVEAKAQQLQEEGERRAAAERQVQQLEEQVQQLEAQVQLLVGRLEGAGQQVCWASTELDKEKARVDSMVRHQESLQAKQRALLKQLDSLDQEREELRGSLDEAEAQRARVEEQLQSEREQGQCQLRAQQELLQSLQREKQGLEQATTDLRLTILELERELEELKERERLLVAFPDLHRPTETQIHGGRSSSVESQITCPTDSGNVTDHMERQVQSNDIRIRVLQEENGRLQSMLSKIREVAQQGGLKLIPQDRLWSPSSKGTQGATPPVQAKSTSPGPLGRQHLPSSRTGRTLLGQPCTSPPRQPCTSPPRQPCTSPPRQPCTSPSRQPCSQPSKSLLEGVTHLDTCTQNPIKVLVRLRKRLSPGRGQASSAHQPQERPM

SEQ ID NO: 18409 - protein, 83 aa, Homo sapiens
  Payload ID: 3678
  Gene Symbol: CCDC157
  Gene Name: coiled-coil domain containing 157
  ENSP ID: ENSP00000382720
MAHLLGSQACMESLRTDLTDLQGAIVDVFSRAGPVRFPSWKFPDRMACDLDMVALLEHYDHVPGDPEFTQLSHAVLLELVIDR

SEQ ID NO: 18410 - protein, 752 aa, Homo sapiens; identical to SEQ ID NO: 18408
  Payload ID: 3678
  Gene Symbol: CCDC157
  Gene Name: coiled-coil domain containing 157
  Uniprot ID: Q569K6
  ENSP ID: ENSP00000385357

SEQ ID NO: 18411 - protein, 196 aa, Homo sapiens
  Payload ID: 3678
  Gene Symbol: CCDC157
  Gene Name: coiled-coil domain containing 157
  ENSP ID: ENSP00000387491
MAHLLGSQACMESLRTDLTDLQGAIVDVFSRAGPVRFPSWKFPDRMACDLDMVALLEHYDHVPGDPEFTQLSHAVLLELVIDRLLLLLQSCMSYLENLGSEQMMPPAQAAGPCMSVGLTVRRFWDSLLRLGTLHQQPLPQKGANQRETPTSKPTTKGEPARSPEYLTTKLIKPSSPVLGLPQTCQEPESIPVRASL

SEQ ID NO: 18412 - protein, 201 aa, Homo sapiens
  Payload ID: 3678
  Gene Symbol: CCDC157
  Gene Name: coiled-coil domain containing 157
  ENSP ID: ENSP00000401837
MAHLLGSQACMESLRTDLTDLQGAIVDVFSRAGPVRFPSWKFPDRMACDLDMVALLEHYDHVPGDPEFTQLSHAVLLELVIDRLLLLLQSCMSYLENLGSEQMMPPAQAAGPCMSVGLTVRRFWDSLLRLGTLHQQPLPQKGANQRETPTSKPTTKGEPARSPEYLTTKLIKPSSPVLGLPQTCQEPESIPVRASLQFPAT

SEQ ID NO: 18413 - protein, 1113 aa, Homo sapiens
  Payload ID: 3679
  Gene Symbol: CCDC158
  Gene Name: coiled-coil domain containing 158
  Uniprot ID: Q5M9N0
  ENSP ID: ENSP00000373566
MESKAWESNNEDLLSSSGVTSNGGSSSSFFVSSIRGTIIENTSSAGTLTQVPFFPKYEVELDSPRKIIPSPGKEHFERVLEEYSHQVKDLQRRLNESNELHEKQKFYLRQSVIDLQTKLQEMQMERDAMADIRRRESQSQEDLRNQLQNTVHELEAAKCLKEDMLKDSNTQIEQLRKMMLSHEGVLQEIRSILVDFEEASGKKICEHDSMSTLHFRSLGSAISKILRELDTEISYLKGRIFPVEDQLEALKSESQNKIELLLQQHQDRIEQLISEHEVEITGLTEKASSARSQANSIQSQMEIIQEQARNQNSMYMRQLSDLESTVSQLRSELREAKRMYEDKTEELEKQLVLANSELTEARTERDQFSQESGNLDDQLQKLLADLHKREKELSLEKEQNKRLWDRDTGNSITIDHLRRELDNRNMEVQRLEALLKALKSECQGQMERQMAAIQGKNESLEKVSSLTAQLESTKEMLRKVVEELTAKKMTLESSERTISDLTTSLQEKERAIEATNAEITKLRSRVDLKLQELQHLKNEGDHLRNVQTECEALKLQMTEKDKVIEILRQQIENMTQLVGQHGRTAGAMQVEKAQLEKEINDRRMELKELKILKDKKDAKIRELEARVSDLELEKVKLVNAGSERLRAVKDIKQERDQLLNEVKTSRSELNNLSEEYEVLKRNFRNKSEEMEMTTNKLKMQLKSAQSELEQTRNTLKSMEGSDGHAMKVAMGMQKQITAKRGQIDALQSKIQFLEEAMTNANKEKHFLKEEKSKLSQELSTVATEKNKMAGELEVLRSQERRLKEKVTNMEVALDKASLQFAECQDIIQRQEQESVRLKLQHTLDIKELQGPGYTSNSSLKPRLLQPASVTRSHSNVPSSQSTASFLSHHSTKANTLKEDPTRDLKQLLQELRSVINEEPAVSLSKTEEDGRTSLGALEDRVRDCITESSLRSDMCHRSNNSLRDSTEGSKSSETLSREPVTLHAGDREDPSGCFTFTSAASPSVKNSASRSFNSSPKKSPVHSLLTSSVEGSIGSTSQYRSAKPIHSSDSVKDSQSPPIETTGKTCRKLQNRLESLQTLVEDLQLKNQAMSSMIRNQEKRIQKVKDQEKMLLK

SEQ ID NO: 18414 - protein, 406 aa, Homo sapiens
  Payload ID: 3679
  Gene Symbol: CCDC158
  Gene Name: coiled-coil domain containing 158
  Uniprot ID: Q5M9N0
  ENSP ID: ENSP00000401742
MESKAWESNNEDLLSSSGVTSNGGSSSSFFVSSIRGTIIENTSSAGTLTQVPFFPKYEVELDSPRKIIPSPGKEHFERVLEEYSHQVKDLQRRLNESNELHEKQKFYLRQSVIDLQTKLQEMQMERDAMADIRRRESQSQEDLRNQLQNTVHELEAAKCLKEDMLKDSNTQIEQLRKMMLSHEGVLQEIRSILVDFEEASGKKICEHDSMSTLHFRSLGSAISKILRELDTEISYLKGRIFPVEDQLEALKSESQNKIELLLQQHQDRIEQLISEHEVEITGLTEKASSARSQANSIQSQMEIIQEQARNQNSMYMRQLSDLESTVSQLRSELREAKRMYEDKENLQNSPLRIWTSRSCHYWLCRFGFTLNFRFLTTKISPDVDSAFIFTTLKAVGAEFCIKKVMI

SEQ ID NO: 18415 - protein, 297 aa, Homo sapiens
  Payload ID: 3680
  Gene Symbol: CCDC159
  Gene Name: coiled-coil domain containing 159
  Uniprot ID: P0C7I6
  ENSP ID: ENSP00000402239
MGEHEQVKPLETSSSKVKAKTIVMIPDSQKLLRCELESLKSQLQAQTKAFEFLNHSVTMLEKESCLQQIKIQQLEEVLSPTGRQGEKEEHKWGMEQGRQELYGALTQGLQGLEKTLRDSEEMQRARTTRCLQLLAQEIRDSKKFLWEELELVREEVTFIYQKLQAQEDEISENLVNIQKMQKTQVKCRKILTKMKQQGHETAACPETEEIPQGASGCWKDDLQKELSDIWSAVHVLQNSIDSLTLCSGACPKASSLRGHKGHQCLSPPLPSWDSDSDCDQDLSQPPFSKSGRSFPPA

SEQ ID NO: 18416 - protein, 155 aa, Homo sapiens
  Payload ID: 3680
  Gene Symbol: CCDC159
  Gene Name: coiled-coil domain containing 159
  ENSP ID: ENSP00000465218
  MOD_RES (1)..(1): Any amino acid
XQKLQAQEDEISENLVNIQKMQKTQVKCRKILTKMKQQGHETAACPETEEIPQGASGCWKDDLQKELSDIWSAVHVLQNSIDSLTLCSGACPKASSLRGHKGHQCLSPPLPSWDSDSDCDQDLSQPPFSKSGRSFPPGADPPQSPPPPISLLTCP

SEQ ID NO: 18417 - protein, 36 aa, Homo sapiens
  Payload ID: 3680
  Gene Symbol: CCDC159
  Gene Name: coiled-coil domain containing 159
  ENSP ID: ENSP00000465290
MGEHEQVVCEALGDQLFQSQSQDHCDDSRLPEAPAM

SEQ ID NO: 18418 - protein, 140 aa, Homo sapiens
  Payload ID: 3680
  Gene Symbol: CCDC159
  Gene Name: coiled-coil domain containing 159
  ENSP ID: ENSP00000465560
MIPDSQKLLRCELESLKSQLQAQTKAFEFLNHSVTMLEKESCLQQIKIQQLEEVLSPTGRQGEKEEHKWGMEQGRQELYGALTQGLQGLEKTLRDSEEMQRARTTRCLQLLAQEIRDSKKFLWEELELVREEVTFIYQKL

SEQ ID NO: 18419 - protein, 36 aa, Homo sapiens; identical to SEQ ID NO: 18417
  Payload ID: 3680
  Gene Symbol: CCDC159
  Gene Name: coiled-coil domain containing 159
  ENSP ID: ENSP00000465744

SEQ ID NO: 18420 - protein, 129 aa, Homo sapiens
  Payload ID: 3680
  Gene Symbol: CCDC159
  Gene Name: coiled-coil domain containing 159
  ENSP ID: ENSP00000465790
MIPDSQKLLRCELESLKSQLQAQTKAFEFLNHSVTMLEKESCLQQIKIQQLEEVLSPTGRQGEKEEHKWGMEQGRQELYGALTQGLQGLEKTLRDSEEMQRARTTRCLQLLAQEIRDSKKFLWEELELV

SEQ ID NO: 18421 - protein, 193 aa, Homo sapiens
  Payload ID: 3680
  Gene Symbol: CCDC159
  Gene Name: coiled-coil domain containing 159
  ENSP ID: ENSP00000466796
ETSSSKVKAKTIVMIPDSQKLLRCELESLKSQLQAQTKAFEFLNHSVTMLEKESCLQQIKIQQLEEAQEDEISENLVNIQKMQKTQVKCRKILTKMKQQGHETAACPETEEIPQGASGCWKDDLQKELSDIWSAVHVLQNSIDSLTLCSGACPKASSLRGHKGHQCLSPPLPSWDSDSDCDQDLSQPPFSKSG

SEQ ID NO: 18422 - protein, 109 aa, Homo sapiens
  Payload ID: 3680
  Gene Symbol: CCDC159
  Gene Name: coiled-coil domain containing 159
  ENSP ID: ENSP00000466882
MIPDSQKLLRCELESLKSQLQAQTKAFEFLNHSVTMLEKESCLQQIKIQQLEEVLSPTGRQGEKEEHKWGMEQGRQELYGALTQGLQGLEKTLRDSEEMQRARTTRCLQ

SEQ ID NO: 18423 - protein, 38 aa, Homo sapiens
  Payload ID: 3680
  Gene Symbol: CCDC159
  Gene Name: coiled-coil domain containing 159
  ENSP ID: ENSP00000467391
MGEHEQVALPRTRLWSVQLTGPGLQSQRPWDALLLGTQ

SEQ ID NO: 18424 - protein, 297 aa, Homo sapiens; identical to SEQ ID NO: 18415
  Payload ID: 3680
  Gene Symbol: CCDC159
  Gene Name: coiled-coil domain containing 159
  Uniprot ID: P0C7I6
  ENSP ID: ENSP00000468232

SEQ ID NO: 18425 - protein, 325 aa, Homo sapiens
  Payload ID: 3681
  Gene Symbol: CCDC160
  Gene Name: coiled-coil domain containing 160
  Uniprot ID: A6NGH7
  ENSP ID: ENSP00000359845
MDARRKHWKENMFTPFFSAQDVLEETSEPESSSEQTTADSSKGMEEIYNLSSRKFQEESKFKRKKYIFQLNEIEQEQNLRENKRNISKNETDTNSASYESSNVDVTTEESFNSTEDNSTCSTDNLPALLRQDIRKKFMERMSPKLCLNLLNEELEELNMKYRKIEEEFENAEKELLHYKKEIFTKPLNFQETETDASKSDYELQALRNDLSEKATNVKNLSEQLQQAKEVIHKLNLENRNLKEAVRKLKHQTEVGNVLLKEEMKSYYELEMAKIRGELSVIKNELRTEKTLQARNNRALELLRKYYASSMVTSSSILDHFTGDFF

SEQ ID NO: 18426 - protein, 325 aa, Homo sapiens; identical to SEQ ID NO: 18425
  Payload ID: 3681
  Gene Symbol: CCDC160
  Gene Name: coiled-coil domain containing 160
  Uniprot ID: A6NGH7
  ENSP ID: ENSP00000427951

SEQ ID NO: 18427 - protein, 118 aa, Homo sapiens
  Payload ID: 3682
  Gene Symbol: CCDC163P
  Gene Name: coiled-coil domain containing 163, pseudogene
  ENSP ID: ENSP00000485784
MNTSLSWFEQLDVLLNATDGNVVRNKQWLYPLGVSTELIGLCICFFCSSGCIFLGSPPQNSTAVTPAVLWEESEIMQKELKLLQYQLSQHQELLLKQLAEGRQAQVGSWKDLHSCCPI

SEQ ID NO: 18428 - protein, 97 aa, Homo sapiens
  Payload ID: 3682
  Gene Symbol: CCDC163P
  Gene Name: coiled-coil domain containing 163, pseudogene
  ENSP ID: ENSP00000486028
MNTSLSWFEQLDVLLNATDGNVVRNKQWLYPLGVSTELIGLCICFFCSSGCIFLGSPPQNSTAVTPAVLWEESEIMQKELKLLQYQPAPGAAAETAG

SEQ ID NO: 18429 - protein, 145 aa, Homo sapiens
  Payload ID: 3682
  Gene Symbol: CCDC163P
  Gene Name: coiled-coil domain containing 163, pseudogene
  ENSP ID: ENSP00000486197
MNTSLSWFEQLDVLLNATDGNVVRNKQWLYPLGVSTELIGLCICFFCSSGCIFLGSPPQNSTAVTPAVLWEESEIMQKELKLLQYQLSQHQELLLKQLAEGRQAQVGSWKIPRGAPFLTWSPASFSSMPRVLSKRTYSFGAPKCS

SEQ ID NO: 18430 - protein, 66 aa, Homo sapiens
  Payload ID: 3682
  Gene Symbol: CCDC163P
  Gene Name: coiled-coil domain containing 163, pseudogene
  ENSP ID: ENSP00000486505
MNTSLSWFEQLDVLLNATDGNVVRNKQWLYPLGVSTELIGLCICFFCSSGCIFLGSPPQASTRSCC

SEQ ID NO: 18431 - protein, 118 aa, Homo sapiens
  Payload ID: 3682
  Gene Symbol: CCDC163P
  Gene Name: coiled-coil domain containing 163, pseudogene
  ENSP ID: ENSP00000487061
MNTSLSWFEQLDVLLNATDGNVVRNKQWLYPLGVSTELIGLCICFFCSSGCIFLGSPPQNSTAVTPAVLWEESEIMQKELKLLQYQLSQHQELLLKQLAEGRQAQVGSWKLLIQSSGQ

SEQ ID NO: 18432 - protein, 439 aa, Homo sapiens
  Payload ID: 3683
  Gene Symbol: CCDC166
  Gene Name: coiled-coil domain containing 166
  Uniprot ID: P0CW27
  ENSP ID: ENSP00000437315
MAPKKKRGPSAGSQPGGAAAAGAEQPLSERAQYLQREHALLSEQLDTCEESVDQVLRENAFLDREALRLREENRLYASYVSARAQRCAKAIVRLDEQNRVDLAQIHWQRAELASLYHGREDGVRAQLLEMEARAAQMAQQVQELQPYKVLQLEQLARIRALERELLHMRVEHTQLLHRVKRRFLEDKAAFEREARQRVQSLARRAEREAVRALVAHTQAIKADNGRLRQELLLLLRRTQLLHHTRRQLLEQREQLHREHEDTRDLARVHGWLRRGPGGPPLWERPAFSQPTSRPGSLAAPISPSRAASQTPSVVPSRAAPRASSVVPSREASRVPSLVLSSMDSRVPSLATSKVGSRMPSLTASRAGSRALSLVQSLEGSGISSGSSPRVSSQDTLRSTKSGPKLLSGLSRDRDPALLPPQSEDSVNAEAAAEASPGRA

SEQ ID NO: 18433 - protein, 439 aa, Homo sapiens; identical to SEQ ID NO: 18432
  Payload ID: 3683
  Gene Symbol: CCDC166
  Gene Name: coiled-coil domain containing 166
  Uniprot ID: P0CW27
  ENSP ID: ENSP00000437468

SEQ ID NO: 18434 - protein, 97 aa, Homo sapiens
  Payload ID: 3684
  Gene Symbol: CCDC167
  Gene Name: coiled-coil domain containing 167
  Uniprot ID: Q9P0B6
  ENSP ID: ENSP00000362507
MTKKKRENLGVALEIDGLEEKLSQCRRDLEAVNSRLHSRELSPEARRSLEKEKNSLMNKASNYEKELKFLRQENRKNMLLSVAIFILLTLVYAYWTM

SEQ ID NO: 18435 - protein, 7081 aa, Homo sapiens
  Payload ID: 3685
  Gene Symbol: CCDC168
  Gene Name: coiled-coil domain containing 168
  Uniprot ID: Q8NDH2
  ENSP ID: ENSP00000320232
MSKQYYSFKKGVGSGLEDNTFMTLWDFLESWIIQNDWVAIFFIILLGIIFEIILMKACASFWKKPTLPEKGSSDVQETEDSCPKSRKLAPENWSVINSSSGERVGTFLEKRITSSLTSEEKECNFEDRILFSREILWSGTSESEDQVSPSSESHVPSSNGISSSLPLFYSEVEETCLSHTEHPDREYETIQFSSKKLFSMMKTNKNKNSGFSSDLSFSASRFTVENEDLDVAPCPLAHLFLSRDQVRLLEENVRNQIPSKPKTKLGSRTTYQCSRSQESLNQNQPSVGMVISVQAQDSFPGQNAFQNQGLYEVQFTSQAQYINHNQESIKSQPESKASNFAQPEDVMKKPFSSSTQDSFQSQDLDRNQHFVEVPSIVEAKYSVKGLESDEHLGEDQHCVWFIDSNKVKYSIKGQDTIFKNAEFLVLTLNPNLVTEDMPQLRSVKAQGQQQIVSSELNQDSVYSSVPLLSTIKGQKNRRKTPDSKSKLSLNVPSLKAKKTPTSQVFQITVCHTLKNRNELGCKNNTEKKELHERKDISDIALHLISVSKLILPYVKNYSRKQLVKVMPGLIKCGHFLQKQNKSPDTEKINYAGPLEETGISDITKKEKEYDKENKRLKNISPKMLPQLEQSFMVNTVQLKAPCLLVETNGKSKESLKDSITQAKGIGITEFHVLNSKKPFDLHIPKHKTSLEEAISKPMQKLVSSPEMESNNRMKIQEDLQSSENSHLQLSNGEELPTSTPKTQRCFPRENTQKQKDFLELVLELSNVGLLISPGSKMHKSSEELEAIKIQVNTESVNLKESKPLILNVTEDSDLRESEELECNTGSNITNMHQDKETSDAFHSATYTTISQLPDTETHSISKAKADTLRIIRLSHSASKQEKLPDEKETQNAEYIDKSCTFKKPQQCDRKEQEKEANSELTQGFRFSIHLKQKPKYVKFQMEQISSGSSKAPNKEQEVQPQTLSTQTILENSPCPMMDPFQVEKVKQSTDRPTDRESAGDPKNPLTMPENLPVGELLIETTEYSVPFGGNLQKTTDSHIAEEKEDVKRYLPAVALGSFNNHLLTLPYFKRQEIKKKLSETKSVLSVKYVIMKVKKPAISLMPYINICGTSNHRKKMGGNFEIIIKQILQDKIAAGMLLNVIYPPMSILPNTRMYSRLNAENHSHIKLVQEESQIEREEKYPYFINEGNESQNTLDAKLQDEVKGVKETLPKAVLHDSCNLGLDAHLEKEIKTEKEMHQPIPFTETIIESVVSPIMELSHAENVKSTQKTQTDCKCTADSETPSPISGKSLIGDPLNQTRESYIPSNGSDTREMGYCFAEEKTEIPKDLPATSPETFNYCTPVLSCSKVMKKRVTFALTTSTAKPKCVNTKAVKPSISETVSVTSHRKKSELDFKTKFKKINQTKGLVPECLNTLCSPMHSRLQREFCLPASQLKQGETADKTYTDVFAKNSISHDREEKLQDGKEEEHKVLLEAAPQLSQHLGSEAGQMKEIHLESDPVLNCLTLELHINGQRLQHQTGFEQTTLETSLQMGPLEAEELQKANETENDIKVLGGPKIPPPKALQALENSDGLILNAYQKDNELVKSDEELNQPGSTNIQVQPQTHFTQTILKSTSCPTLDQFPFEKVESHVRFSPLKSGEAKVDEIIFYAREGGISSDSSHQKEQAGGTEKKETAIFGSCMPALSTPKTTRNLKQFSDMKTLVNPKCGIIKAKKPSISYMLNIRAGAGPKRRKELSCNLTTKMKELHQGKKGVDETYAFLTMTPDINKYSKVETEKDTLREKRLSSTQVKQDTSPHEDSITSRDIKETLLQDEEQEERKQEALLKVIPQHLQHFMFRSGQGKDLDFHKLENQGSRKILFVTKQDVPQQLQPAEPIQREETKKCLQTQNGTICTVNSKLLPLKSEDSVNGEVLTGAIKRGVPTDRKCMGEQHNSGKGEKAEFNKDLQATVLELQKSPHGGEAQKANLTDMESGSSNAMNMNVQHEREDKNIQKMLTESVPCYSQHLRFSTHQMKDPDPCKSGSEPKSPEGRSWNLSHIVQKTKQETHFRETVLEPISGYMMKQSPHMQEGIKCMEGLKTSFPKTGKSKIGSIPRDTPWDENPRRKWDSSISEKTAWNQKNLQTVLKPLDFSSLMSSEYESRSYTLEFIGKKSMSPKCVTLKAKQLRILQLFNIIRYSTENHRKKKQHRFKYKMKGKQWYTSIGEALLSATEYAKSTTSKSMIDKLLYNTAARCILSNRTRRQNLDGHITEEKEEVQENVAAIFLGLLDFFMPVLSDSKNQRNTAQLSEKEIIFNAKCLTMKEKKSSISQIHKINRESTRKHRKKCKSYLKTVSNRKCQENHGHITEEEEEVQENSPATFLGPLDFFMPVLSDSKNQINTIQLSERKIILNPKCLTMKEKKPPISQIHKISGQFTTKHRKKLESNLKTKLKAMWQGENVADTFPNTTSFTPDSSDIKRQSGFQTEIDMRISGLSHTQPTQIESLAEGIARYSDPIDKRRTSNLVKGAKLHDRESGEEKQEHLTEMDPFYAENFMANTYLRKDRHLGKSEDVLLGETFFSKSQIYKGNSEKNVKIEKNKNGKESLKVGLARMEKSDNCAELSEATDDAISNKYDKQNIGHSVLKENAFCNLAAIVPDSVGRHSPASEEMKRQNGRLKMADRSSPQGRPLQAKQSAVSQSPDTAGYAVVSNNKEQKQNFKAQKTEAEVDLIDQEAKINVAEEFNPESVFFSKIHPLQIENKKEFKTADWKTRADPKTFALPKKQQELCVSGTIWSYPNPYTSISPKIIRHKDKAKTADVESTMHTKQIKLKAKRITVSQLLEYGTASNKKELRGNIQQQKSFQLSKNAVHRVLKAVYDSGYCVSSIKKLTEVKMEKDKPKDRTCILPQPKLEKPLKEMQRSLSGCTDMSSILRKQEQDIREKEQKHQSISEDISQYYIGPLRISSQQINYSSFDAPRIRTDEELEFLIAQRAKEKDVGIAKHSVSIPWEREGSKRLDIPLNSKGQNIFFTELDTSQQKTCQEQELLKQEDISMTNLGSMACPIMEPLHLENTGKVTEEEDVYINRKISSHVLGKEGLKETDIFVGSKGQKFLCTNSEVQHKVPAEQKEQVNPDHVPESILDSESFLSKDPLHLKQAVNTARKENVTISESFNENLWGKEQSKLDITLKSNRQKMDFSKKLRMKHLSNYYQNKENILESVLPCILHQLYIENPKKEGSAEEIMSSKVLSPMVEKASHEVGIPVDQPPCSEGIHLNIKGRKEHPQESTHEAFPASVSHSLMDVLQIKSPKVKKALKAINSLGYLTSNTKGIGLLFPRQAEKEEKYTYKALPKPASHSKTDLFQFNASMQQEKLDAMDIPHYDYLTSQTREAVKQMDVIVGYTQNSKKRQDLLKTGQKWQYLPISYENFWEHISCPQKYPCLLQHLMPQEKEALSEGGNLSSRTPGLDLFSADQLSTITKNRLEWIVPLISPRQMKKQDSMLPLGSYHKTIKYASLLFPKGMKSSDGVQVFDLISNNSSPKLRLGKKIETQKANEKVQKEVCLPITLHSLSASMPILQESKGQKDSVEQVIRKGVICHKRRTSKWKKSVFSHILNTSDCGASSNRLEMQWNMTDKMVNVKHRMSEIDLVAAKICESILSLPHFKLNKETIDGVISSNVKSTKQHISQGKNDRVKAMDMKRIKSPNIILKPRKSSLSHILSIKEFPLLLDIIKQEGKMQEGKGKSSMKLTNLCTSLPSLSHSNSNSRTKAGKDKSGTLKGCLPPLKLQASSNARRVSSAESINRDSLSNVIESKCFPQKKKEDRENIVDVKDVMGLKCITLKGKKSLFRHLLHGKEPQRSNKKLEKMTQEDESNLNVVQNKLCASILSPPHLEWNPRIKEVYMRGITRFCLSSSTQQELSDTMEKCEQPIDDSLSSIEKAKHMPQKDKDRVEKALEKIMHSKRIALEVKQPSIFQELELNIKEKGGKIQEDKEVEIWSKPFASISFLPYSKVGTIEGEEAMRIKMRSSFSQPNLQESSDTEKTAYEKCISDNISNSVKKALESILQKEQRQKMEKIRALKKMKSSISQGIQLDIKEQEKRIEHIKGEPSVLLTNACASIPSPSHLQLDTRREKAEYVTEITRYYLPELSHQKSSEAGEKADGVASKGDITIKVQKAKDYMQQKEDDEVKISAKKDIMHPEDKGLKAKKALSQDLPLNTKEPGKMDQEAQEQGKEDREGEEQGKEDRRGAGQEKVDREDKEQGKMDHEVEEQQKADGVGIEQGKMDGDKNEQERVLFLYLPSNSSLTHYILDTRIEGEEDQQGIIRPGILQPRHQKSSETGKKANGVPSEGDSASEVQKAKDYMQQKEEDEVKISAEKDLMHPEDKDLKGKKALSQNLPLNPKEPGKRDGEGQEQGKEDGEGEEQGNRDGETEEQQQADGVGTEQEKRDGHKSKQETVLFLHLPSESSLTCYELNTRKEGEEDLQGIIKSATLQLRQQKSFDAGKIAHTKSFGVDSSNDVKTVQEYKPQKEVDRGKTVSVDYIMQPEGTIFEAEQLSLPHTLNIPGSSGSKTREVLTNIKEKLRHVQERKSELDVFLTIPSLSHCKLDKRTAGKKEEQGVTRSFLPPSWHMESSDTGKLKYTLSYLNDITGDSNRTKYMAQIQKDKANISEKSVMHPEYIAVKAEKSPLSHILKTKELQVNISQQGEKAQEGEVEIVVLLSKTCPFVTSSAFLELDSIKEEEGEPRITRSFMPHLEIQESLPSRQTAPTKPTESLVKKEKQLLPQKEDRVQTVSMHGLMHPNGAVFKAKTSAPPQVFSITEHSPLSKRKEPQWGMKERAGQKQDRTGRPHVILTKTHPFMPSLSHHRFSPSQPKLPISSGAGKSRLANSNEGISSHKVILKANQQMPYKEAKDRVKIEGREGRILPKRIHLRAEALPLALLCNGKNYSLHIEEQGEGVQESKKEPGVVPRKSASFPPPPFYLNCDTRRNEKEGTLGKTQFSFPPLKIQDSSDSGKKAYTESLHGYTLSNSKGPVQPTAQGEEKGGLRIDMEDKMLPKCTDLKAKQLLLSDILNTKKLQWKSKEQKRKIQEDKNKQVKGLPSINTSLLTPPYLKFDTTEGQENVIRIAKVSLPQSRSKESSDAGRIACPEATHGELSSDVKQLKAHLLQKEEKDREKVADMTSVLDPNKMYLKAKKSPVLHTHSFSDLQWKTREQEEEKVQKVKSGPGVMLSKSPSRSSPLHLNVNTGFQEESIPILTRPSFPLVKLQVSPDTEGGTCIRPIAGDILIYLQKGKHVSQNKEEDDVQIVSILIFPKHQEEKVQECEGEPGVVLTKSTSLPSLSQLELDKETHLGNEMLRLKRPILRRISHIGETVHRESVVGDIPKDVKNEKQHIPQKEERNQKKIIDMRGTDITLKSKKSPRSCMLHRTELHVNIGGQGRKEHEGQDKPPGMIQRKMCILFSKPLPSNLKLERATHADEERLGGKTSFVLPLMPSALPDTEKTADAEARSGDVRKGKPHRSQKENRHEVKTIDMRFRIHCQEARISPMSHILNAKELVLNINKLEKKVHKDKDEACVVLSRTFLSIPSAPPLYLDSGNKTDKDTPGITGSSCPQRTLHVPSNTQKITNRDSVEGVDKNVVKQAEQYVPRPEAEQQLTSNFMISVQQRNQPSRVRSEEDLNQLVLNSRDEDIYFTGFGTIRSGKRPEWLFTGKKAQPVKYKTETLTAFLSYPTMDATKMGGLEEDTEIMDNLNHKISPKASVSLIRKISKELYVTLGTPANSKGFSVSERYAHQQETSSKVSPELAGSCKFDKPKEDGQSNDRISKMFSPKVLAPQTKGSLKKISIVTNWNAPQNIEEQDIVMKKQVIRRCEHGHKTRTNTILSKFPLQSGKQKTPSETDVDKKTTAHLSLQMLPGIHMDMTEIDPAKGGRKQALLISEQEEGVLEFLPKSLFPPWTFQFQSGDLEEKHQTDANTNINLEQKKLEMDNDSTVNQKEGKLKIGTNRALHLQEEKTEMHKARTANLEKERGRMDTSSSAHPHLLSLKAEESQMKTQVITHRENSRLIMQKQKKELEASNAKQSIQLQKLFQRNVLDSFYSYVPLSPKRKDQKGRLTIRDLKRELSTKYLTMKIQNHPIPQMLNITGRGTPSNRKKLEYDVKLKNIASWSKDVSGIFIRSLSISIMRSPHTDPKTNLEREKRICLPKFQEKSPNTSEMSKRDTLTIVKGEQNFTNTVPQDPQPFAVDKQQMQKLPNVKSEANLRSEMNKKYLKAQTKERIVPEHDVSRIIKKPDLRIIEQEEKILKRILTPTECPSMLEDPKLPKQRDQSEPVWDMTTQKVQQQKAFPGTVPIPPQVKSSEVKIVADSTNAEHLLPICEATKAISESQVKNMIQDKVSSDKLDNIQAYKPDDLKSPPFPEGPDTISTAIYPKTQHKSLLEQFTPKEKNKLTSHLESKALEIQLNLIPEMARKSLQMFNFYPKGTISKDNSWRFYSRHKTMNFMSLEGTDTIEPNSKHKHQKDSPLASNMKTLIVDVSSDSEETITKLQSINKLENGTSAVTSASEMLLPHTLQNHSVKEKGKLLMHFSVKTLEIQMKAFPRIVRESYAMTSAHERKKPLSNCIHPGFTGPKRQNRILLLSEEKSLHQIDLDLQYKYLRFLLGLPVGSTFPKPNVLPKHSKLNTIAVCKNVNAGGQSGSLSIDTELLEQHISFKKQSPHENSSLIRKFPQPTLVCASDRDLHSPRKKDTQVLSESEFHVTPEKNKQYHVWFQERNTCESVDLRTQRNATGSAVSCETQISEDFVDIQTDIESPADLDECSCLEVSESEECVFLEANSYLSQESENILFELQTGIPLENVYKITTDLKSFYSEDSGSHCTRECRKETLIITPPSCKSHKSRKYRSSSKMKSPDWLCHSSSNTAEIQSRSSSVSFSEEKISWTTKSRTSYSSAPLTESNIKSHLAKNQGKSHRHPESQERKKARSDLFRKNSSHWDHDYSCTHSKGKRDRKKRVYDYESERLDCFQSKHKSASKPHHDDINFYSERKQNRPFFFACVPADSLEVIPKTIRWTIPPETLRKRNFRIPLVAKISSSWNIWSSSKKLLGSLSGSLTTVFHS

SEQ ID NO: 18436 - protein, 214 aa, Homo sapiens
  Payload ID: 3686
  Gene Symbol: CCDC169
  Gene Name: coiled-coil domain containing 169
  Uniprot ID: A6NNP5
  ENSP ID: ENSP00000239859
MKEERNYNFDGVSTNRLKQQLLEEVRKKDAVQLSIFELRHKITELEAKLNTDNEGSEWKTRYETQLELNDELEKQIVYLKEKVEKIHGNSSDRLSSIRVYERMPVESLNTLLKQLEEEKKTLESQVKYYALKLEQESKAYQKINNERRTYLAEMSQGSGLHQVSKRQQVDQLPRMQENLVKTGRYNPAKQKTVSAKRGPVKKITRPNHLPELHP

SEQ ID NO: 18437 - protein, 141 aa, Homo sapiens
  Payload ID: 3686
  Gene Symbol: CCDC169
  Gene Name: coiled-coil domain containing 169
  Uniprot ID: A6NNP5
  ENSP ID: ENSP00000239860
METLQESLNTLLKQLEEEKKTLESQVKYYALKLEQESKAYQKINNERRTYLAEMSQGSGLHQVSKRQQVDQLPRMQENLVKTLLLKEELDPLKVSCLETLGFSAAGVAGPENRTCLGQKALWPACLHGSSTLAVCQTHLKS

SEQ ID NO: 18438 - protein, 112 aa, Homo sapiens
  Payload ID: 3686
  Gene Symbol: CCDC169
  Gene Name: coiled-coil domain containing 169
  Uniprot ID: A6NNP5
  ENSP ID: ENSP00000369191
MPVESLNTLLKQLEEEKKTLESQVKYYALKLEQESKAYQKINNERRTYLAEMSQGSGLHQVSKRQQVDQLPRMQENLVKTGRYNPAKQKTVSAKRGPVKKITRPNHLPELHP

SEQ ID NO: 18439 - protein, 139 aa, Homo sapiens
  Payload ID: 3686
  Gene Symbol: CCDC169
  Gene Name: coiled-coil domain containing 169
  Uniprot ID: A6NNP5
  ENSP ID: ENSP00000369193
MPVESLNTLLKQLEEEKKTLESQVKYYALKLEQESKAYQKINNERRTYLAEMSQGSGLHQVSKRQQVDQLPRMQENLVKTLLLKEELDPLKVSCLETLGFSAAGVAGPENRTCLGQKALWPACLHGSSTLAVCQTHLKS

SEQ ID NO: 18440 - protein, 91 aa, Homo sapiens
  Payload ID: 3686
  Gene Symbol: CCDC169
  Gene Name: coiled-coil domain containing 169
  ENSP ID: ENSP00000420862
MPVESLNTLLKQLEEEKKTLESQVKYYALKLEQESKAYQKINNERRTYLAEMSQGSGLHQVSKRQQVDQLPRMQENLVKTFKVTKSPKGRK

SEQ ID NO: 18441 - protein, 139 aa, Homo sapiens; identical to SEQ ID NO: 18439
  Payload ID: 3686
  Gene Symbol: CCDC169
  Gene Name: coiled-coil domain containing 169
  Uniprot ID: A6NNP5
  ENSP ID: ENSP00000425252

SEQ ID NO: 18442 - protein, 241 aa, Homo sapiens
  Payload ID: 3686
  Gene Symbol: CCDC169
  Gene Name: coiled-coil domain containing 169
  Uniprot ID: A6NNP5
  ENSP ID: ENSP00000426174
MKEERNYNFDGVSTNRLKQQLLEEVRKKDAVQLSIFELRHKITELEAKLNTDNEGSEWKTRYETQLELNDELEKQIVYLKEKVEKIHGNSSDRLSSIRVYERMPVESLNTLLKQLEEEKKTLESQVKYYALKLEQESKAYQKINNERRTYLAEMSQGSGLHQVSKRQQVDQLPRMQENLVKTLLLKEELDPLKVSCLETLGFSAAGVAGPENRTCLGQKALWPACLHGSSTLAVCQTHLKS

SEQ ID NO: 18443 - protein, 112 aa, Homo sapiens; identical to SEQ ID NO: 18438
  Payload ID: 3686
  Gene Symbol: CCDC169
  Gene Name: coiled-coil domain containing 169
  Uniprot ID: A6NNP5
  ENSP ID: ENSP00000427495

SEQ ID NO: 18444 - protein, 59 aa, Homo sapiens
  Payload ID: 3687
  Gene Symbol: CCDC17
  Gene Name: coiled-coil domain containing 17
  ENSP ID: ENSP00000361114
MDSHSGEPALLPCGTCDMVFRSSALLATHTQRFCIGHPTQEMTFGAQASVATEPQRAAN

SEQ ID NO: 18445 - protein, 613 aa, Homo sapiens
  Payload ID: 3687
  Gene Symbol: CCDC17
  Gene Name: coiled-coil domain containing 17
  Uniprot ID: Q96LX7
  ENSP ID: ENSP00000389415
MDSHSGEPALLPCGTCDMVFRSSALLATHTQRFCIGHPTQEMTFGAQASVATEPQRAAVVPQEHQGVPQEPQGLPDQQASRSALKRLTEEEMRPWITEVPRVFAGPWTRSEARPQSPMSEAVGSPSERLRALFRTRARRVAEMEAQSRALQLRGEELSRRLQVVACTRGGMSRLFGLEQEIRELQAEAGRTRGALEVLGARIQELQAEPGNPLSSRREAELYSPVQKANPGTLAAEIRALREAYIRDGGRDPGVLGQIWQLQVEASALELQRSQTRRGRAGATSGELPVVEAENRRLEAEILALQMQRGRAPLGPQDLRLLGDASLQPKGRRDPPLLPPPVAPPLPPLPGFSEPQLPGTMTRNLGLDSHFLLPTSDMLGPAPYDPGAGLVIFYDFLRGLEASWIWVQLRTGLARDGRDTGRTTALPPALCLPPPPAPGPMGNCAILASRQPVPRLPPSSSVSLVCELQVWQGLAWARAPQPKAWVSLGLFDQDQRVLSGRWRLPLRALPLDPSLSLGQLNGIPQAGQAELFLRLVNARDAAVQTLAEINPASVHEYQYPPPVSSTSSLEASFLTPAVGFADPPPRTEEPLSGVKDRDEGLGPHHSSDLPPVSF

SEQ ID NO: 18446 - protein, 110 aa, Homo sapiens
  Payload ID: 3687
  Gene Symbol: CCDC17
  Gene Name: coiled-coil domain containing 17
  Uniprot ID: Q96LX7
  ENSP ID: ENSP00000411335
MDSHSGEPALLPCGTCDMVFRSSALLATHTQRFCIGHPTQEMTFGAQASVATEPQRAAVSSTSSLEASFLTPAVGFADPPPRTEEPLSGVKDRDEGLGPHHSSDLPPVSF

SEQ ID NO: 18447 - protein, 622 aa, Homo sapiens
  Payload ID: 3687
  Gene Symbol: CCDC17
  Gene Name: coiled-coil domain containing 17
  Uniprot ID: Q96LX7
  ENSP ID: ENSP00000432172
MDSHSGEPALLPCGTCDMVFRSSALLATHTQRFCIGHPTQEMTFGAQASVATEPQRAAVVPQEHQGVPQEPQGLPDQQASRSALKRLTEEVQWLRLSLQEMRPWITEVPRVFAGPWTRSEARPQSPMSEAVGSPSERLRALFRTRARRVAEMEAQSRALQLRGEELSRRLQVVACTRGGMSRLFGLEQEIRELQAEAGRTRGALEVLGARIQELQAEPGNPLSSRREAELYSPVQKANPGTLAAEIRALREAYIRDGGRDPGVLGQIWQLQVEASALELQRSQTRRGRAGATSGELPVVEAENRRLEAEILALQMQRGRAPLGPQDLRLLGDASLQPKGRRDPPLLPPPVAPPLPPLPGFSEPQLPGTMTRNLGLDSHFLLPTSDMLGPAPYDPGAGLVIFYDFLRGLEASWIWVQLRTGLARDGRDTGRTTALPPALCLPPPPAPGPMGNCAILASRQPVPRLPPSSSVSLVCELQVWQGLAWARAPQPKAWVSLGLFDQDQRVLSGRWRLPLRALPLDPSLSLGQLNGIPQAGQAELFLRLVNARDAAVQTLAEINPASVHEYQYPPPVSSTSSLEASFLTPAVGFADPPPRTEEPLSGVKDRDEGLGPHHSSDLPPVSF

SEQ ID NO: 18448 - protein, 564 aa, Homo sapiens
  Payload ID: 3687
  Gene Symbol: CCDC17
  Gene Name: coiled-coil domain containing 17
  ENSP ID: ENSP00000437072
MDSHSGEPALLPCGTCDMVFRSSALLATHTQRFCIGHPTQEMTFGAQASVATEPQRAAVQWLRLSLQEMRPWITEVPRVFAGPWTRSEARPQSPMSEAVGSPSERLRALFRTRARRVAEMEAQSRALQLRGEELSRRLQVVACTRGGMSRLFGLEQEIRELQAEAGRTRGALEVLGARIQELQAEPGNPLSSRREAELYSPVQKANPGTLAAEIRALREAYIRDGGRDPGVLGQIWQLQVEASALELQRSQTRRGRAGATSGELPVVEAENRRLEAEILALQMQRGRAPLGPQDLRLLGDASLQPKGRRDPPLLPPPVAPPLPPLPGFSEPQLPGTMTRNLGLDSHFLLPTSDMLGPAPYDPGAGLVIFYDFLRGLEASWIWVQLRTGLARDGRDTGRTTALPPALCLPPPPAPGPMGNCAILASRQPVPRLPPSSSVSLVCELQVWQGLAWARAPQPKAWVSLGLFDQDQRVLSGRWRLPLRALPLDPSLSLGQLNGIPQAGQAELFLRLVNARDAAVQTLAEINPASVHEYQYPPPVRAQLQLGTPQLHIPVWLVWLTASLY

SEQ ID NO: 18449 - protein, 715 aa, Homo sapiens
  Payload ID: 3688
  Gene Symbol: CCDC170
  Gene Name: coiled-coil domain containing 170
  Uniprot ID: Q8IYT3
  ENSP ID: ENSP00000239374
MSLDCTSHIALGAASPAPEETYDHLSEVPVTREQLNHYRNVAQNARSELAATLVKFECAQSELQDLRSKMLSKEVSCQELKAEMESYKENNARKSSLLTSLRDRVQELEEESAALSTSKIRTEITAHAAIKENQELKKKVVELNEKLQKCSKENEENKKQVSKNCRKHEEFLTQLRDCLDPDERNDKASDEDLILKLRDLRKENEFVKGQIVILEETINVHEMEAKASRETIMRLASEVNREQKKAASCTEEKEKLNQDLLSAVEAKEALEREVKIFQERLLAGQQVWDASKQEVSLLKKSSSELEKSLKASQDAVTTSQSQYFSFREKIAALLRGRLSMTGSTEDTILEKIREMDSREESRDRMVSQLEAQISELVEQLGKESGFHQKALQRAQKAENMLETLQGQLTHLEAELVSGGVLRDNLNFEKQKYLKFLDQLSQKMKLDQMAAELGFDMRLDVVLARTEQLVRLESNAVIENKTIAHNLQRKLKTQKERLESKELHMSLLRQKIAQLEEEKQARTALVVERDNAHLTIRNLQKKVERLQKELNTCRDLHTELKAKLADTNELKIKTLEQTKAIEDLNKSRDQLEKMKEKAEKKLMSVKSELDTTEHEAKENKERARNMIEVVTSEMKTLKKSLEEAEKREKQLADFREVVSQMLGLNVTSLALPDYEIIKCLERLVHSHQHHFVTCACLKDVTTGQERHPQGHLQLLH

SEQ ID NO: 18450 - protein, 1326 aa, Homo sapiens
  Payload ID: 3689
  Gene Symbol: CCDC171
  Gene Name: coiled-coil domain containing 171
  Uniprot ID: Q6TFL3
  ENSP ID: ENSP00000370077
MNLNTSSNTGDTQRLKIASLDVKQILKNETELDITDNLRKKLHWAKKEKLEITTKHNAELASYESQIAKLRSEVEKGEALRQSLEYDLAVARKEAGLGRRAAEERLAEAHRIQEKLCAQNSELQAKTNETEKAFQTSQQKWKEECRRFEHDLEERDNMIQNCNREYDLLMKEKSRLEKTLQEALEKHQREKNEMESHIRETALEEFRLQEEQWEAERRELQFIVQEQDTAVQNMHKKVEKLETEHMDCSDLLRRQTSELEFSTQREERLRKEFEATTLRVRKLEENIEAERAAHLESKFNSEIIQLRIRDLEGALQVEKASQAEAVADLEIIKNEFKEVESAYEREKHNAQESFAKLNLLEKEYFSKNKKLNEDIEEQKKVIIDLSKRLQYNEKSCSELQEELVMAKKHQAFLVETCENNVKELESILDSFTVSGQWTSGIHKDKDKPPSFSVVLERLRRTLTDYQNKLEDASNEEKACNELDSTKQKIDSHTKNIKELQDKLADVNKELSHLHTKCADREALISTLKVELQNVLHCWEKEKAQAAQSESELQKLSQAFHKDAEEKLTFLHTLYQHLVAGCVLIKQPEGMLDKFSWSELCAVLQENVDALIADLNRANEKIRHLEYICKNKSDTMRELQQTQEDTFTKVAEQIKAQESCWHRQKKELELQYSELFLEVQKRAQKFQEIAEKNMEKLNHIEKSHEQLVLENSHFKKLLSQTQREQMSLLAACALMAGALYPLYSRSCALSTQRDFLQEQVNTFELFKLEIRTLAQALSTVEEKKQEEAKMKKKTFKGLIRIFRKGVIAVLAANRLKILGQSCASLFTWMESFKEGIGMLVCTGEPQDKHKFPKHQKEQLRCLQALSWLTSSDLLAAIISSMAELQDVIGKADPNSRICGHLLIGAAKNSFAKLMDKISLVMECIPLHSSRSITYVEKDSLVQRLAHGLHKVNTLALKYGLRGHVPITKSTASLQKQILGFTQRLHAAEVERRSLRLEVTEFKRSVNEMKKELDKAQGLQMQLNEFKQSKLITHEKFESACEELNNALLREEQAQMLLNEQAQQLQELNYKLELHSSEEADKNQTLGEAVKSLSEAKMELRRKDQSLRQLNRHLTQLEQDKRRLEENIHDAESALRMAAKDKECVANHMRAVENTLHKVRDQISLSWSAASRNDFTLQLPKLHLETFAMEGLKGGPEVVACQAMIKSFMDVYQLASTRIMTLEKEMTSHRSHIAALKSELHTACLRENASLQSIGSRDHSNLSIPSRAPLPADTTGIGDFLPLKAELDTTYTFLKETFINTVPHALTSSHSSPVTMSANANRPTQIGL

SEQ ID NO: 18451 - protein, 257 aa, Homo sapiens
  Payload ID: 3689
  Gene Symbol: CCDC171
  Gene Name: coiled-coil domain containing 171
  ENSP ID: ENSP00000399526
  MOD_RES (1)..(1): Any amino acid
XHKVNTLALKYGLRGHVPITKSTASLQKQILGFTQRLHAAEVERRSLRLEVTEFKRSVNEMKKELDKAQGLQMQLNEFKQSKLITHEKFESACEELNNALLREEQAQMLLNEQAQQLQELNYKLELHSSEEADKNQTLGEAVKSLSEAKMELRRKDQSLRQLNRHLTQLEQDKRRLEENIHDAESALRMAAKDKECVANHMRAVENTLHKVRDQISLSWSAASRNDFTLQLPKLHLETFAMEGLKGGPEVVACQVRV

SEQ ID NO: 18452 - protein, 469 aa, Homo sapiens
  Payload ID: 3689
  Gene Symbol: CCDC171
  Gene Name: coiled-coil domain containing 171
  ENSP ID: ENSP00000409055
  MOD_RES (1)..(1): Any amino acid
XFELFKLEIRTLAQALSTVEEKKQEEAKMKKKTFKGLIRIFRKGVIAVLAANRLKILGQSCASLFTWMESFKEGIGMLVCTGEPQDKHKFPKHQKEQLRCLQALSWLTSSDLLAAIISSMAELQDVIGKADPNSRICGHLLIGAAKNSFAKLMDKISLVMECIPLHSSRSITYVEKDSLVQRLAHGLHKVNTLALKYGLRGHVPITKSTASLQKQILGFTQRLHAAEVERRSLRLEVTEFKRSVNEMKKELDKAQGLQMQLNEFKQSKLITHEKFESACEELNNALLREEQAQMLLNEQAQQLQELNYKLELHSSEEADKNQTLGEAVKSLSEAKMELRRKDQSLRQLNRHLTQLEQDKRRLEENIHDAESALRMAAKDKECVANHMRAVENTLHKVRDQISLSWSAASRNDFTLQLPKLHLETFAMEGLKGGPEVVACQVRVQWCDHSSLQSQMPGLKQSSCLSLLST

SEQ ID NO: 18453 - protein, 317 aa, Homo sapiens
  Payload ID: 3689
  Gene Symbol: CCDC171
  Gene Name: coiled-coil domain containing 171
  ENSP ID: ENSP00000438838
MNLNTSSNTGDTQRLKIASLDVKQILKNETELDITDNLRKKLHWAKKEKLEITTKHNAELASYESQIAKLRSEVEKGEALRQSLEYDLAVARKEAGLGRRAAEERLAEAHRIQEKLCAQNSELQAKTNETEKAFQTSQQKWKEECRRFEHDLEERDNMIQNCNREYDLLMKEKSRLEKTLQEALEKHQREKNEMESHIRETALEEFRLQEEQWEAERRELQFIVQEQDTAVQNMHKKVEKLETEHMDCSDLLRRQTSELEFSTQREERLRKEFEATTLRVRKLEENIEAERAAHLESKFNSEIIQVKCKQIFWPAFS

SEQ ID NO: 18454 - protein, 258 aa, Homo sapiens
  Payload ID: 3690
  Gene Symbol: CCDC172
  Gene Name: coiled-coil domain containing 172
  Uniprot ID: P0C7W6
  ENSP ID: ENSP00000329860
MSLESLFQHIIFTEHQAEESRRLMREVRSEITRCREKIKKATEELNEEKIKLESKVQQFFEKSFFLQLLKAHENALEKQYSEITNHRNMLLQTFEAIKKQMIEEEDKFIKEITDFNNDYEITKKRELLMKENVKIEISDLENQANMLKSEMKSMEHDSSQLNELQKQKSELIQELFTLQRKLKVFEDEENESICTTKYLEAEKIKISEKPQNDTECLRLKKELELYKEDDMESVYEALQTEIEFLELTLAQKDLQESK

SEQ ID NO: 18455 - protein, 552 aa, Homo sapiens
  Payload ID: 3691
  Gene Symbol: CCDC173
  Gene Name: coiled-coil domain containing 173
  Uniprot ID: Q0VFZ6
  ENSP ID: ENSP00000391504
MDTSSEMLVRFGRRCGRAKESTEIRNSEEDQVLYLPLLPSKVDLQQVTIIPHDEWKRIQDSLDRLTREAACLRAERKAKKEMHLRSQEVVKHWTNTYAGMKEQKLEAKKKRDEEIEAERQILDLEEEIYKQGKRKKAIENAKQYQFYQTERVKNFHSGLLLSRVMKERDAQIEFRKSKIKSDKKWEEQLKLNIEKAFKEEQEKAEKRHRERVALAKDHLKQIKEHEEEEERRKKYEEKDAEEIKRQNALYEIEMRKKLEKKREEMHESRRRFLEHMQDKHIIKAVEQQQQEEEDEKMRKFIKAKKRLIQMGKEKEAETHRLMEKRRERIHNFLSELLKEKLDNEDMIIARDIAEAEAEWEKREREKDEKNKAELKTIAEYRAIVMKNKEEEERQRKIEAKEQLLAVMKADQIFWEHEKEKKCKADKEHQEVQDAHIQQMAKNKFNAKQAKQAELDYCRLTEALVAEKEKEFQDYAREVIELESETTNKYIYPLVKAVQEGPGGGRGPVFVDRGGLRPSYQANDVTGVQLPFYNSQGPKYNFQKSKRRLGFTW

SEQ ID NO: 18456 - protein, 158 aa, Homo sapiens
  Payload ID: 3691
  Gene Symbol: CCDC173
  Gene Name: coiled-coil domain containing 173
  ENSP ID: ENSP00000405608
MKEQKLEAKKKRDEEIEAERQILDLEEEIYKQGKRKKAIENAKQYQFYQTERVKNFHSGLLLSRVMKERDAQIEFRKSKIKSDKKWEEQLKLNIEKAFKEEQEKAEKRHRERVALAKDHLKQIKEHEEEEERRKKYEEKDAEEIKRQNALYEIEMRKK

SEQ ID NO: 18457 - protein, 108 aa, Homo sapiens
  Payload ID: 3691
  Gene Symbol: CCDC173
  Gene Name: coiled-coil domain containing 173
  ENSP ID: ENSP00000408143
MPISELLRRISLKLFPKVDLQQVTIIPHDEWKRIQDSLDRLTREAACLRAERKAKKEMHLRSQEVVKHWTNTYAGMKEQKLEAKKKRDEEIEAERQILDLEEEIYKQG

SEQ ID NO: 18458 - protein, 391 aa, Homo sapiens
  Payload ID: 3692
  Gene Symbol: CCDC174
  Gene Name: coiled-coil domain containing 174
  ENSP ID: ENSP00000302344
MDRRKKPLDVTASSLVDLKAELFRKQEEFKQEKLLKDSGVFGKPKTTNKKPSIWSKQNVGVSNRAEKDAEQKIEEQKTLDKAREKLEEKAKLYEKMTKGDFIDEEVEDMYLVDFTQKIIDKRKEMEASGAHRDSQKAGERDDDEENLPEGEIPPPQDPSEEWVDYVDSLGRSRRCMRKDLPDLLEMDKNLQGRLFISPANEKTLLSEDMRKELQRQQWEEEEREALKRPMGPVHYEDIRENDGDVIGPLPPEPEAVPTPRPAAQSSKVEVIVQERKDTKPGVPHIREWDRGKEFSFGYWSKRQSDLRAERDPEFAPPSDYFVGQKRTGFSSSQAWSRPGPAQSDPGQCPDQSHGPSPEHTSPTPAPDNPPQAPTVTFKTLDDMISYYKQVT

SEQ ID NO: 18459 - protein, 467 aa, Homo sapiens
  Payload ID: 3692
  Gene Symbol: CCDC174
  Gene Name: coiled-coil domain containing 174
  Uniprot ID: Q6PII3
  ENSP ID: ENSP00000373304
MDRRKKPLDVTASSLVDLKAELFRKQEEFKQEKLLKDSGVFGKPKTTNKKPSIWSKQNVGVSNRAEKDAEQKIEEQKTLDKAREKLEEKAKLYEKMTKGDFIDEEVEDMYLVDFTQKIIDKRKEMEASGAHRDSQKAGERDDDEENLPEGEIPPPQDPSEEWVDYVDSLGRSRRCMRKDLPDLLEMDKNLQGRLFISPANEKTLLSEDMRKELQRQQWEEEEREALKRPMGPVHYEDIRENEARQLGVGYFAFARDKELRNKQMKTLEMLREQTTDQRTKRENIKEKRKAILEARLAKLRQKKMKKSKEGGTEEENRDGDVIGPLPPEPEAVPTPRPAAQSSKVEVIVQERKDTKPGVPHIREWDRGKEFSFGYWSKRQSDLRAERDPEFAPPSDYFVGQKRTGFSSSQAWSRPGPAQSDPGQCPDQSHGPSPEHTSPTPAPDNPPQAPTVTFKTLDDMISYYKQVT

SEQ ID NO: 18460 - protein, 294 aa, Homo sapiens [sequence omitted]

SEQ ID NO: 18461 - protein, 828 aa, Homo sapiens
  Payload ID: 3693
  Gene Symbol: CCDC175
  Gene Name: coiled-coil domain containing 175
  ENSP ID: ENSP00000452964
MALSPWTPGLGAGEKLVQAAAVSTGPSLELCTLPSTLGSSVAVEALEQLFVVEQSLQSDYFKCNEEAKIFLKDIAVAVKKLEEMRKATIDLLEIESMELNKLYYLLETLPNSIKRELEECVRDARRLNLFEINTIKMRITRTENEIELLKKKITDLTKYNEALGEKQEELARKHARFVLSLNQTMEKKATTTVYINETYTKINLKREDIALQKKCIQEAEELMEKERAEYLIRKQELTAQINEFENTREVKRMETYQKKKELDKLQTKMSKIKETVTVSAAVLSDHNLEIARLHESIRYWEQEVSELKKDLAILEAKLCFFTDNKEKLDDISNDEKNEFLNKIKQLVETLHAARMEYKDLREKMKTLARQYKIVLSEEEKAFLQKQKIHDENQKQLTFISQKEYFLSQKRVDIKNMEEGLITLQELQQATKTVYQQQIKILSANLERESQRCVITQWKMACLRKKHARWTAKIKAEIQAITEKIQNAEVRRIELLNETSFRQQEISGFVAQIEKLTTELKEEEKAFVNKEKMLMKELSKYEEIFVKETQINKEKEEELVEYLPQLQVAEQEYKEKRRKLEELSNIITAQRQEEDLLNNHIFLFTRDFSRYISNMEDVKQELQQLRDQESKKNKDHFETLKNLENGFYINDQKADLLLLENKKLKEYILYLKNNIEKYREGQEALMHTSSDLSRQLIAQEAQYKDLWAEFQTTVKILVDNGEETLQDINNLTDKLRERDEKMQHVSTWLRGSLEGLRLLVEQESPMDLLSKQQLRALLVTSKEEKTCQLSDLVIPNYATNIQLNIDTYLGLNTLVVLSNSAFHLREFSR

SEQ ID NO: 18462 - protein, 793 aa, Homo sapiens
  Payload ID: 3693
  Gene Symbol: CCDC175
  Gene Name: coiled-coil domain containing 175
  Uniprot ID: P0C221
  ENSP ID: ENSP00000453940
MALSPWTPGLGAGEKLVQAAAVSTGPSLELCTLPSTLGSSVAVEALEQLFVVEQSLQSDYFKCNEEAKIFLKDIAVAVKKLEEMRKATIDLLEIESMELNKLYYLLETLPNSIKRELEECVRDARRLNLFEINTIKMRITRTENEIELLKKKITDLTKYNEALGEKQEELARKHARFVLSLNQTMEKKATTTVYINETYTKINLKREDIALQKKCIQEAEELMEKERAEYLIRKQELTAQINEFENTREVKRMETYQKKKELDKLQTKMSKIKETVTVSAAVLSDHNLEIARLHESIRYWEQEVSELKKDLAILEAKLCFFTDNKEKLDDISNDEKNEFLNKIKQLVETLHAARMEYKDLREKMKTLARQYKIVLSEEEKAFLQKQKIHDENQKQLTFISQKEYFLSQKRVDIKNMEEGLITLQELQQATKTVYQQQIKILSANLERESQRCVITQWKMACLRKKHARWTAKIKAEIQAITEKIQNAEVRRIELLNETSFRQQEISGFVAQIEKLTTELKEEEKAFVNKEKMLMKELSKYEEIFVKETQINKEKEEELVEYLPQLQVAEQEYKEKRRKLEELSNIITAQRQEEDLLNNHIFLFTRDFSRYISNMEDVKQELQQLRDQESKKNKDHFETLKNLENGFYINDQKADLLLLENKKLKEYILYLKNNIEKYREGQEALMHTSSDLSRQLIAQEAQYKDLWAEFQTTVKILVDNGEETLQDINNLTDKLRERDEKMQHVSTWLRGSLEGLRLLVEQESPMDLLKKKKHIRTRVHFPVVKCTEKNTLTK

SEQ ID NO: 18463 - protein, 707 aa, Homo sapiens
  Payload ID: 3694
  Gene Symbol: CCDC177
  Gene Name: coiled-coil domain containing 177
  Uniprot ID: Q9NQR7
  ENSP ID: ENSP00000469474
MVDPVPEEEKAGAEPGDSGGDEAVASVPPDSQGAQEPAASSASASASAAVPRKAEVPCAAAEGGRREQSPLLHLDLFNFDCPEAEGSRYVLTSPRSLEACARCAVKPVELLPRALADLVREAPGRSMRVATGLYEAYEAERRAKLQQCRAERERIMREEKRRLFTPLSPAAAAAAAAAAASAPSAGSSSSCSSASLPASPAPRAARKASPSPSSARTQPPPAGSRTGRKSHSLDSLSRRREGALSSESGASSSSYSGESLRELRWPPRASARNSCPAGSASSTTNAPGRPSALTLVPITGRSFSLGDLSHSPQTAQHVERIVRQVRAERGLRGVPERDRKIAALMLARHQEELLLLEQRAAAHGQWELQRVHAKQRREREEREKQRALEQGRRAWAAQVEERRGRRGREEREAARRRQRQYERSEERRRELAERQGLLRRERAERAAREDRLRKLQQEQNLKQREEGLQEGRERAEQIRRERAQRAARAKQRQEGQLQREKRELSRAERARHEALLQGRTRQQRQEREGLRSSLEASLGRAQENYEHLVEQRTRELRERARREELQGRRAKEAAERKEREHQAHLEALARAGERRLQHATQVAEEAVQQKARRVGQSRLEKERAQRANKEKVERDEDCRRRELLQAIGRKLERSEQLTRERRSALESARSTARASFHVREKVREETNTRSFDRMVREAQLHASLDRK

SEQ ID NO: 18464 - protein, 829 aa, Homo sapiens
  Payload ID: 3695
  Gene Symbol: CCDC178
  Gene Name: coiled-coil domain containing 178
  Uniprot ID: Q5BJE1
  ENSP ID: ENSP00000300227
MTENKTVSSSSTRDDQTNIGLTCQEVKALREKAWSRTNEGNAMSQSLVLYGASKENSEGFHESKMTNTEGVNKGIYFSYPCRRHSCAVVNIPAPCVNKMISHIQDVESKIQEHLKRFETSFEEWSRTSSTKDLKEDWSVTTPVKEVKPGEKRDEKCPELKQEMETLLSEAIRLIKSLETDRADAEEALKQQRSRKNMINMKIDSWSVWKLQELPLAVQKEHEAYLSDVIELQWHLEDKANQLQHFEKQKTELEEANAKIQADIDYMNEHGPLLDSKQNQELQDLKNHYKKKMEVMDLHRKVNEELEEALEACENARLKAQQIKEEIDKDIYQDEKTIEAYKREIYQLNSLFDHYSSSVINVNTNIEEKEEEVTEAIRETKSSKNELHSLSKMLEDLRRVYDQLTWKQKSHENQYLEAVNDFYAAKKTWDIELSDVAKDFSAISLACTKLTEDNKKLEIDINKITVKTNESIRKKSKYESEIKYLTIMKLKNDKHLKNIYKEAYRIGTLFHLTKHKTDEMEDKIAEVRRKFKGREEFLKKLTQGEVAAGMVLQKKLYSIYEVQALERKELIKNRAICAMSLAELQEPLLQLEDEAERIRSLDKEHSVSKRSAIFKDLEATKSKTMIFYAKINELNEELKAKEEEKKSFDQTLEILKNKFITMRFKREHAQTVFDHYMQEKKDCEERIFEEDQRFRVLLAVRQKTLQDTQKIIADSLEENLRLAQEYQQLQITFLKEKDNYFNIYDKQLSLDTSIRDKKQLCQLQRRMHTLWQEHFKLVVLFSQMRLANFQTDSQESIQKILAVQEESSNLMQHILGFFQTLTDGTCENDG

SEQ ID NO: 18465 - protein, 867 aa, Homo sapiens
  Payload ID: 3695
  Gene Symbol: CCDC178
  Gene Name: coiled-coil domain containing 178
  Uniprot ID: Q5BJE1
  ENSP ID: ENSP00000372576
MTENKTVSSSSTRDDQTNIGLTCQEVKALREKAWSRTNEGNAMSQSLVLYGASKENSEGFHESKMTNTEGVNKGIYFSYPCRRHSCAVVNIPAPCVNKMISHIQDVESKIQEHLKRFETSFEEWSRTSSTKDLKEDWSVTTPVKEVKPGEKRDEKCPELKQEMETLLSEAIRLIKSLETDRADAEEALKQQRSRKNMINMKIDSWSVWKLQELPLAVQKEHEAYLSDVIELQWHLEDKANQLQHFEKQKTELEEANAKIQADIDYMNEHGPLLDSKQNQELQDLKNHYKKKMEVMDLHRKVNEELEEALEACENARLKAQQIKEEIDKDIYQDEKTIEAYKREIYQLNSLFDHYSSSVINVNTNIEEKEEEVTEAIRETKSSKNELHSLSKMLEDLRRVYDQLTWKQKSHENQYLEAVNDFYAAKKTWDIELSDVAKDFSAISLACTKLTEDNKKLEIDINKITVKTNESIRKKSKYESEIKYLTIMKLKNDKHLKNIYKEAYRIGTLFHLTKHKTDEMEDKIAEVRRKFKGREEFLKKLTQGEVAAGMVLQKKLYSIYEVQALERKELIKNRAICAMSLAELQEPLLQLEDEAERIRSLDKEHSVMLNNIIDQKDLIRRKVGKVKKKLRKKGKKTLDALIETESKRSAIFKDLEATKSKTMIFYAKINELNEELKAKEEEKKSFDQTLEILKNKFITMRFKREHAQTVFDHYMQEKKDCEERIFEEDQRFRVLLAVRQKTLQDTQKIIADSLEENLRLAQEYQQLQITFLKEKDNYFNIYDKQLSLDTSIRDKKQLCQLQRRMHTLWQEHFKLVVLFSQMRLANFQTDSQESIQKILAVQEESSNLMQHILGFFQTLTDGTCENDG

SEQ ID NO: 18466 - protein, 291 aa, Homo sapiens
  Payload ID: 3695
  Gene Symbol: CCDC178
  Gene Name: coiled-coil domain containing 178
  ENSP ID: ENSP00000382130
MTENKTVSSSSTRDDQTNIGLTCQEVKALREKAWSRTNEGNAMSQSLVLYGASKENSEGFHESKMTNTEGVNKGIYFSYPCRRHSCAVVNIPAPCVNKMISHIQDVESKIQEHLKRFETSFEEWSRTSSTKDLKEDWSVTTPVKEVKPGEKRDEKCPELKQEMETLLSEAIRLIKSLETDRADAEEALKQQRSRKNMINMKIDSWSVWKLQELPLAVQKEHEAYLSDVIELQWHLEDKANQLQHFEKQKTELEEANAKIQADIDYMNEHGPLLDSKQNQELQDLKNHYKKK

SEQ ID NO: 18467 - protein, 867 aa, Homo sapiens; identical to SEQ ID NO: 18465
  Payload ID: 3695
  Gene Symbol: CCDC178
  Gene Name: coiled-coil domain containing 178
  Uniprot ID: Q5BJE1
  ENSP ID: ENSP00000385591

SEQ ID NO: 18468 - protein, 891 aa, Homo sapiens
  Payload ID: 3695
  Gene Symbol: CCDC178
  Gene Name: coiled-coil domain containing 178
  ENSP ID: ENSP00000385867
MTENKTVSSSSTRDDQTNIGLTCQEVKALREKAWSRTNEGNAMSQSLVLYGASKENSEGFHESKMTNTEGVNKGIYFSYPCRRHSCAVVNIPAPCVNKMISHIQDVESKIQEHLKRFETSFEEWSRTSSTKDLKEDWSVTTPVKEVKPGEKRDEKCPELKQEMETLLSEAIRLIKSLETDRADAEEALKQQRSRKNMINMKIDSWSVWKLQELPLAVQKEHEAYLSDVIELQWHLEDKANQLQHFEKQKTELEEANAKIQADIDYMNEHGPLLDSKQNQELQDLKNHYKKKMEVMDLHRKVNEELEEALEACENARLKAQQIKEEIDKDIYQDEKTIEAYKREIYQLNSLFDHYSSSVINVNTNIEEKEEEVTEAIRETKSSKNELHSLSKMLEDLRRVYDQLTWKQKSHENQYLEAVNDFYAAKKTWDIELSDVAKDFSAISLACTKLTEDNKKLEIDINKITVKTNESIRKKSKYESEIKYLTIMKLKNDKHLKNIYKEAYRIGTLFHLTKHKTDEMEDKIAEVRRKFKGREEFLKKLTQGEVAAGMVLQKKLYSIYEVQALERKELIKNRAICAMSLAELQEPLLQLEDEAERIRSLDKEHSVMLNNIIDQKDLIRRKVGKVKKKLRKKGKKTLDALIETESKRSAIFKDLEATKSKTMIFYAKINELNEELKAKEEEKKSFDQTLEILKNKFITMRFKREHAQTVFDHYMQEKKDCEERIFEEDQRFRVLLAVRQKTLQDTQKIIADSLEENLRLAQEYQQLQITFLKEKDNYFNIYDKQLSLDTSIRDKKQVAGFLPKKLPNSLPIISDELSNFQLCQLQRRMHTLWQEHFKLVVLFSQMRLANFQTDSQESIQKILAVQEESSNLMQHILGFFQTLTDGTCENDG

SEQ ID NO: 18469 - protein, 187 aa, Homo sapiens
  Payload ID: 3695
  Gene Symbol: CCDC178
  Gene Name: coiled-coil domain containing 178
  ENSP ID: ENSP00000462153
MTENKTVSSSSTRDDQTNIGLTCQEVKALREKAWSRTNEGNAMSQSLVLYGASKENSEGFHESKMTNTEGVNKGIYFSYPCRRHSCAVVNIPAPCVNKMISHIQDVESKIQEHLKRLCQLQRRMHTLWQEHFKLVVLFSQMRLANFQTDSQESIQKILAVQEESSNLMQHILGFFQTLTDGTCENDG

SEQ ID NO: 18470 - protein, 849 aa, Homo sapiens
  Payload ID: 3695
  Gene Symbol: CCDC178
  Gene Name: coiled-coil domain containing 178
  Uniprot ID: Q5BJE1
  ENSP ID: ENSP00000462370
MTENKTVSSSSTRDDQTNIGLTCQEVKALREKAWSRTNEGNAMSQSLVLYGASKENSEGFHESKMTNTEGVNKGIYFSYPCRRHSCAVVNIPAPCVNKMISHIQDVESKIQEHLKRFETSFEEWSRTSSTKDLKEDWSVTTPVKEVKPGEKRDEKCPELKQEMETLLSEAIRLIKSLETDRADAEEALKQQRSRKNMINMKIDSWSVWKLQELPLAVQKEHEAYLSDVIELQWHLEDKANQLQHFEKQKTELEEANAKIQADIDYMNEHGPLLDSKQNQELQDLKNHYKKKMEVMDLHRKVNEELEEALEACENARLKAQQIKEEIDKDIYQDEKTIEAYKREIYQLNSLFDHYSSSVINVNTNIEEKEEEVTEAIRETKSSKNELHSLSKMLEDLRRVYDQLTWKQKSHENQYLEAVNDFYAAKKTWDIELSDVAKDFSAISLACTKLTEDNKKLEIDINKITVKTNESIRKKSKYESEIKYLTIMKLKNDKHLKNIYKEAYRIGTLFHLTKHKTDEMEDKIAEVRRKFKGREEFLKKLTQGEVAAGMVLQKKLYSIYEVQALERKELIKNRAICAMSLAELQEPLLQLEDEAERIRSLDKEHSVMLNNIIDQKDLIRRKVGKVKKKLRKKGKKTLDALIETESKRSAIFKDLEATKSKTMIFYAKINELNEELKAKEEEKKSFDQTLEILKNKFITMRFKREHAQTVFDHYMQEKKDCEERIFEEDQRFRVLLAVRQKTLQDTQKIIADSLEENLRLAQEYQQLQITFLKEKDNYFNIYDKQLSLDTSIRDKKQLCQLQRRMHTLWQEHFKLVVLFSQMRLANFQTDSQESIQKILAVQNQYDLEKE

SEQ ID NO: 18471 - protein, 364 aa, Homo sapiens
  Payload ID: 3695
  Gene Symbol: CCDC178
  Gene Name: coiled-coil domain containing 178
  ENSP ID: ENSP00000462651
KKLEIDINKITVKTNESIRKKSKYESEIKYLTIMKLKNDKHLKNIYKEAYRIGTLFHLTKHKTDEMEDKIAEVRRKFKGREEFLKKLTQGEVAAGMVLQKKLYSIYEVQALERKELIKNRAICAMSLAELQEPLLQLEDEAERIRSLDKEHSVMLNNIIDQKDLIRRKVGKVKKKLRKKGKKTLDALIETESKRSAIFKDLEATKSKTMIFYAKINELNEELKAKEEEKKSFDQTLEILKNKFITMRFKREHAQTVFDHYMQEKKDCEERIFEEDQRFRVLLAVRQKTLQDTQLCQLQRRMHTLWQEHFKLVVLFSQMRLANFQTDSQESIQKILAVQEESSNLMQHILGFFQTLTDGTCENDG

SEQ ID NO: 18472 - protein, 103 aa, Homo sapiens
  Payload ID: 3695
  Gene Symbol: CCDC178
  Gene Name: coiled-coil domain containing 178
  ENSP ID: ENSP00000463236
MTENKTVSSSSTRDDQTNIGLTCQEVKALREKAWSRTNEGNAMSQSLVLYGASKENSEGFHESKMTNTEGVNKGIYFSYPCRRHSCAVVNIPAPCVNKMISHI

SEQ ID NO: 18473 - protein, 891 aa, Homo sapiens; identical to SEQ ID NO: 18468
  Payload ID: 3695
  Gene Symbol: CCDC178
  Gene Name: coiled-coil domain containing 178
  ENSP ID: ENSP00000463254

SEQ ID NO: 18474 - protein, 72 aa, Homo sapiens
  Payload ID: 3695
  Gene Symbol: CCDC178
  Gene Name: coiled-coil domain containing 178
  ENSP ID: ENSP00000464295
MLCQLQRRMHTLWQEHFKLVVLFSQMRLANFQTDSQESIQKILAVQEESSNLMQHILGFFQTLTDGTCENDG

SEQ ID NO: 18475 - protein, 68 aa, Homo sapiens
  Payload ID: 3696
  Gene Symbol: CCDC179
  Gene Name: coiled-coil domain containing 179
  Uniprot ID: H3BU77
  ENSP ID: ENSP00000457511
MCLYCWDIEPSQVNPEGPRQHHPSEVTERQLANKRIQNMQHLKKEKRRLNKRFSRPSPIPEPGLLWSS

SEQ ID NO: 18476 - protein, 1454 aa, Homo sapiens
  Payload ID: 3697
  Gene Symbol: CCDC18
  Gene Name: coiled-coil domain containing 18
  Uniprot ID: Q5T9S5
  ENSP ID: ENSP00000343377
MESSSSDYYNKDNEEESLLANVASLRHELKITEWSLQSLGEELSSVSPSENSDYAPNPSRSEKLILDVQPSHPGLLNYSPYENVCKISGSSTDFQKKPRDKMFSSSAPVDQEIKSLREKLNKLRQQNACLVTQNHSLMTKFESIHFELTQSRAKVSMLESAQQQAASVPILEEQIINLEAEVSAQDKVLREAENKLEQSQKMVIEKEQSLQESKEECIKLKVDLLEQTKQGKRAERQRNEALYNAEELSKAFQQYKKKVAEKLEKVQAEEEILERNLTNCEKENKRLQERCGLYKSELEILKEKLRQLKEENNNGKEKLRIMAVKNSEVMAQLTESRQSILKLESELENKDEILRDKFSLMNENRELKVRVAAQNERLDLCQQEIESSRVELRSLEKIISQLPLKRELFGFKSYLSKYQMSSFSNKEDRCIGCCEANKLVISELRIKLAIKEAEIQKLHANLTANQLSQSLITCNDSQESSKLSSLETEPVKLGGHQVESVKDQNQHTMNKQYEKERQRLVTGIEELRTKLIQIEAENSDLKVNMAHRTSQFQLIQEELLEKASNSSKLESEMTKKCSQLLTLEKQLEEKIVAYSSIAAKNAELEQELMEKNEKIRSLETNINTEHEKICLAFEKAKKIHLEQHKEMEKQIERLEAQLEKKDQQFKEQEKTMSMLQQDIICKQHHLESLDRLLTESKGEMKKENMKKDEALKALQNQVSEETIKVRQLDSALEICKEELVLHLNQLEGNKEKFEKQLKKKSEEVYCLQKELKIKNHSLQETSEQNVILQHTLQQQQQMLQQETIRNGELEDTQTKLEKQVSKLEQELQKQRESSAEKLRKMEEKCESAAHEADLKRQKVIELTGTARQVKIEMDQYKEELSKMEKEIMHLKRDGENKAMHLSQLDMILDQTKTELEKKTNAVKELEKLQHSTETELTEALQKREVLETELQNAHGELKSTLRQLQELRDVLQKAQLSLEEKYTTIKDLTAELRECKMEIEDKKQELLEMDQALKERNWELKQRAAQVTHLDMTIREHRGEMEQKIIKLEGTLEKSELELKECNKQIESLNDKLQNAKEQLREKEFIMLQNEQEISQLKKEIERTQQRMKEMESVMKEQEQYIATQYKEAIDLGQELRLTREQVQNSHTELAEARHQQVQAQREIERLSSELEDMKQLSKEKDAHGNHLAEELGASKVREAHLEARMQAEIKKLSAEVESLKEAYHMEMISHQENHAKWKISADSQKSSVQQLNEQLEKAKLELEEAQDTVSNLHQQVQDRNEVIEAANEALLTKESELTRLQAKISGHEKAEDIKFLPAPFTSPTEIMPDVQDPKFAKCFHTSFSKCTKLRRSISASDLTFKIHGDEDLSEELLQDLKKMQLEQPSTLEESHKNLTYTQPDSFKPLTYNLEADSSENNDFNTLSGMLRYINKEVRLLKKSSMQTGAGLNQGENV

SEQ ID NO: 18477 - protein, 1508 aa, Homo sapiens
  Payload ID: 3697
  Gene Symbol: CCDC18
  Gene Name: coiled-coil domain containing 18
  ENSP ID: ENSP00000359299
  MOD_RES (1)..(1): Any amino acid
XFEFCAAGVRWFSELCPRLPRAGARERVRGFLTQTRVRSAQSPGGSLPSDDLGEMESSSSDYYNKDNEEESLLANVASLRHELKITEWSLQSLGEELSSVSPSENSDYAPNPSRSEKLILDVQPSHPGLLNYSPYENVCKISGSSTDFQKKPRDKMFSSSAPVDQEIKSLREKLNKLRQQNACLVTQNHSLMTKFESIHFELTQSRAKVSMLESAQQQAASVPILEEQIINLEAEVSAQDKVLREAENKLEQSQKMVIEKEQSLQESKEECIKLKVDLLEQTKQGKRAERQRNEALYNAEELSKAFQQYKKKVAEKLEKVQAEEEILERNLTNCEKENKRLQERCGLYKSELEILKEKLRQLKEENNNGKEKLRIMAVKNSEVMAQLTESRQSILKLESELENKDEILRDKFSLMNENRELKVRVAAQNERLDLCQQEIESSRVELRSLEKIISQLPLKRELFGFKSYLSKYQMSSFSNKEDRCIGCCEANKLVISELRIKLAIKEAEIQKLHANLTANQLSQSLITCNDSQESSKLSSLETEPVKLGGHQVESVKDQNQHTMNKQYEKERQRLVTGIEELRTKLIQIEAENSDLKVNMAHRTSQFQLIQEELLEKASNSSKLESEMTKKCSQLLTLEKQLEEKIVAYSSIAAKNAELEQELMEKNEKIRSLETNINTEHEKICLAFEKAKKIHLEQHKEMEKQIERLEAQLEKKDQQFKEQEKTMSMLQQDIICKQHHLESLDRLLTESKGEMKKENMKKDEALKALQNQVSEETIKVRQLDSALEICKEELVLHLNQLEGNKEKFEKQLKKKSEEVYCLQKELKIKNHSLQETSEQNVILQHTLQQQQQMLQQETIRNGELEDTQTKLEKQVSKLEQELQKQRESSAEKLRKMEEKCESAAHEADLKRQKVIELTGTARQVKIEMDQYKEELSKMEKEIMHLKRDGENKAMHLSQLDMILDQTKTELEKKTNAVKELEKLQHSTETELTEALQKREVLETELQNAHGELKSTLRQLQELRDVLQKAQLSLEEKYTTIKDLTAELRECKMEIEDKKQELLEMDQALKERNWELKQRAAQVTHLDMTIREHRGEMEQKIIKLEGTLEKSELELKECNKQIESLNDKLQNAKEQLREKEFIMLQNEQEISQLKKEIERTQQRMKEMESVMKEQEQYIATQYKEAIDLGQELRLTREQVQNSHTELAEARHQQVQAQREIERLSSELEDMKQLSKEKDAHGNHLAEELGASKVREAHLEARMQAEIKKLSAEVESLKEAYHMEMISHQENHAKWKISADSQKSSVQQLNEQLEKAKLELEEAQDTVSNLHQQVQDRNEVIEAANEALLTKESELTRLQAKISGHEKAEDIKFLPAPFTSPTEIMPDVQDPKFAKCFHTSFSKCTKLRRSISASDLTFKIHGDEDLSEELLQDLKKMQLEQPSTLEESHKNLTYTQPDSFKPLTYNLEADSSENNDFNTLSGMLRYINKEVRLLKKSSMQTGAGLNQGENV

SEQ ID NO: 18478 - protein, 1299 aa, Homo sapiens
  Payload ID: 3697
  Gene Symbol: CCDC18
  Gene Name: coiled-coil domain containing 18
  ENSP ID: ENSP00000383808
MESSSSDYYNKDNEEESLLANVASLRHELKITEWSLQSLGEELSSVSPSENSDYAPNPSRSEKLILDVQPSHPGLLNYSPYENVCKISGSSTDFQKKPRDKMFSSSAPVDQEIKSLREKLNKLRQQNACLVTQNHSLMTKFESIHFELTQSRAKVSMLESAQQQAASVPILEEQIINLEAEVSAQDKVLREAENKLEQSQKMVIEKEQSLQESKEECIKLKVDLLEQTKQGKRAERQRNEALYNAEELSKAFQQYKKKVAEKLEKVQAEEEILERNLTNCEKENKRLQERCGLYKSELEILKEKLRQLKEENNNGKEKLRIMAVKNSEVMAQLTESRQSILKLESELENKDEILRDKFSLMNENRELKVRVAAQNERLDLCQQEIESSRVELRSLEKIISQLPLKRELFGFKSYLSKYQMSSFSNKEDRCIGCCEANKLVISELRIKLAIKEAEIQKLHANLTANQLSQSLITCNDSQESSKLSSLETEPVKLGGHQVAESVKDQNQHTMNKQYEKERQRLVTGIEELRTKLIQIEAENSDLKVNMAHRTSQFQLIQEELLEKASNSSKLESEMTKKCSQLLTLEKQLEEKIVAYSSIAAKNAELEQELMEKNEKIRSLETNINTEHEKICLAFEKAKKIHLEQHKEMEKQIERLEAQLEKKDQQFKEQEKTMSMLQQDIICKQHHLESLDRLLTESKGEMKKENMKKDEALKALQNQVSEETIKVRQLDSALEICKEELVLHLNQLEGNKEKFEKQLKKKSEEVYCLQKELKIKNHSLQETSEQNVILQHTLQQQQQMLQQETIRNGELEDTQTKLEKQVSKLEQELQKQRESSAEKLRKMEEKCESAAHEADLKRQKVIELTGTARQVKIEMDQYKEELSKMEKEIMHLKRDGENKAMHLSQLDMILDQTKTELEKKTNAVKELEKLQHSTETELTEALQKREVLETELQNAHGELKSTLRQLQELRDVLQKAQLSLEEKYTTIKDLTAELRECKMEIEDKKQELLEMDQALKERNWELKQRAAQVTHLDMTIREHRGEMEQKIIKLEGTLEKSELELKECNKQIESLNDKLQNAKEQLREKEFIMLQNEQEISQLKKEIERTQQRMKEMESVMKEQEQYIATQYKEAIDLGQELRLTREQVQNSHTELAEARHQQVQAQREIERLSSELEDMKQLSKEKDAHGNHLAEELGASKVREAHLEARMQAEIKKLSAEVESLKEAYHMEMISHQENHAKWKISADSQKSSVQQLNEQLEKAKLELEEAQDTVSNLHQQVQDRNEVIEAANEALLTKGENV

SEQ ID NO: 18479 - protein, 720 aa, Homo sapiens
  Payload ID: 3697
  Gene Symbol: CCDC18
  Gene Name: coiled-coil domain containing 18
  ENSP ID: ENSP00000391151
EKENKRLQERCGLYKSELEILKEKLRQLKEENNNGKEKLRIMAVKNSEVMAQLTESRQSILKLESELENKDEILRDKFSLMNENRELKVRVAAQNERLDLCQQEIESSRVELRSLEKIISQLPLKRELFGFKSYLSKYQMSSFSNKEDRCIGCCEANKLVISELRIKLAIKEAEIQKLHANLTANQLSQSLITCNDSQESSKLSSLETEPVKLGGHQVESVKDQNQHTMNKQYEKERQRLVTGIEELRTKLIQIEAENSDLKVNMAHRTSQFQLIQEELLEKASNSSKLESEMTKKCSQLLTLEKQLEEKIVAYSSIAAKNAELEQELMLEAQLEKKDQQFKEQEKTMSMLQQDIICKQHHLESLDRLLTESKGEMKKENMKKDEALKALQNQVSEETIKVRQLDSALEICKEELVLHLNQLEGNKEKFEKQLKKKSEEVYCLQKELKIKNHSLQETSEQNVILQHTLQQQQQMLQQETIRNGELEDTQTKLEKQVSKLEQELQKQRESSAEKLRKMEEKCESAAHEADLKRQKVIELTGTARQVKIEMDQYKEELSKMEKEIMHLKRDGENKAMHLSQLDMILDQTKTELEKKTNAVKELEKLQHSTETELTEALQKREVLETELQNAHGELKSTLRQLQELRDVLQKAQLSLEEKYTTIKDLTAELRECKMEIEDKKQELLEMDQALKERNWELKQRAAQVTHLDMTIREHRGEMEQK

SEQ ID NO: 18480 - protein, 166 aa, Homo sapiens
  Payload ID: 3697
  Gene Symbol: CCDC18
  Gene Name: coiled-coil domain containing 18
  ENSP ID: ENSP00000394234
  MOD_RES (1)..(1): Any amino acid
XPRRFEFCAAGVRWFSELCPRLPRAGARERVRGFLTQTRVRSAQSPEMESSSSDYYNKDNEEESLLANVASLRHELKITEWSLQSLGEELSSVSPSENSDYAPNPSRSEKLILDVQPSHPGLLNYSPYENVCKISGSSTDFQKKPRDKMFSSSAPVDQEIKSLREK

SEQ ID NO: 18481 - protein, 443 aa, Homo sapiens
  Payload ID: 3697
  Gene Symbol: CCDC18
  Gene Name: coiled-coil domain containing 18
  ENSP ID: ENSP00000431409
  MOD_RES (1)..(1): Any amino acid
XPRLPRAGARERVRGFLTQTRVRSAQSPGGSLPSDDLGEMESSSSDYYNKDNEEESLLANVASLRHELKITEWSLQSLGEELSSVSPSENSDYAPNPSRSEKLILDVQPSHPGLLNYSPYENVCKISGSSTDFQKKPRDKMFSSSAPVDQEIKSLREKLNKLRQQNACLVTQNHSLMTKFESIHFELTQSRAKVSMLESAQQQAASVPILEEQIINLEAEVSAQDKVLREAENKLEQSQKMVIEKEQSLQESKEECIKLKVDLLEQTKQGKRAERQRNEALYNAEELSKAFQQYKKKVAEKLEKVQAEEEILERNLTNCEKENKRLQERCGLYKSELEILKEKLRQLKEENNNGKEKLRIMAVKNSEVMAQLTESRQSILKLESELENKDEILRDKFSLMNENRELKVRVAAQNERLDLCQQEIESSRVELRSLEKIISQLPN

SEQ ID NO: 18482 - protein, 95 aa, Homo sapiens
  Payload ID: 3697
  Gene Symbol: CCDC18
  Gene Name: coiled-coil domain containing 18
  ENSP ID: ENSP00000434031
SELCPRLPRAGARERVRGFLTQTRVRSAQSPEMESSSSDYYNKDNEEESLLANVASLRHELKITEWSLQSLGEELSRCFHLLPLWIRRLKAFERN

SEQ ID NO: 18483 - protein, 1701 aa, Homo sapiens
  Payload ID: 3698
  Gene Symbol: CCDC180
  Gene Name: coiled-coil domain containing 180
  Uniprot ID: Q9P1Z9
  ENSP ID: ENSP00000434727
MRGGENRPPARVQSSSEELELRHQSLDAFPGRRLPGRGIQPAAKMSSVGKVTQVPNGKAYQQIFQAEVQLVHSLAATRKRAAERSVTLKSGRIPMMKKVETPEGEVMSPRQQKWMHSLPNDWIMENPVLHREKERAKREKARESENTIAAREVRGLMDTIVPEKISTSTFQRQAEHKRKSYESALASFQEEIAQVGKEMEPLIVDTGGLFLKKLTESDEEMNRLFLKVENDTNLEDYTIQALLELWDKVAGRLLLRKQEIKELDEALHSLEFSRTDKLKSVLKKYAEVIEKTSYLMRPEVYRLINEEAMVMNYALLGNRKALAQLFVNLMESTLQQELDSRHRWQGLVDTWKALKKEALLQSFSEFMASESIHTPPAVTKELEVMLKTQNVLQQRRLKHLCTICDLLPPSYSKTQLTEWHSSLNSLNKELDTYHVDCMMRIRLLYEKTWQECLMHVQNCKKQLLDWKAFTEEEAETLVNQFFFQMVGALQGKVEEDLELLDKSFETLADQTEWQSSHLFKYFQEVVQLWEAHQSELLVQELELEKRMEQHRQKHSLESQVQEAHLDRLLDQLRQQSDKETLAFHLEKVKDYLKNMKSRYECFHTLLTKEVMEYPAIMLKELNSYSSALSQYFFVREIFEQNLAGEVIFKFRQPEAHEKPSQKRVKKLRKKQGSKEDMTRSEESISSGTSTARSVEEVEEENDQEMESFITEEVLGQQKKSPLHAKMDESKEGSIQGLEEMQVEREGSLNPSLNEENVKGQGEKKEESEEEDEKEEEEEEEKLEEEKEEKEAQEEQESLSVGEEEDKEEGLEEIYYEDMESFTISSGNTYFVFVPLEEEHCRKSHSTFSAMFINDTSSAKFIEQVTIPSRLILEIKKQLRAGFFEHLEKWFDQCSLNTRVTVATKINELDSELELHLHLHQPRAQQIEKDIHNVRAAELLLHQEQLDSHCAGVTETLKKKRLMFCQFQEEQNVRSKNFRLKIYDMEHIFLNATRSQKLVTLSNTLHQELLSYVDVTQVSLRSFRQYLEESLGKLRYSNIEFIKHCRLFSEGGNFSPKEINSLCSRLEKEAARIELVESVIMLNMEKLENEYLDQANDVINKFESKFHNLSVDLIFIEKIQRLLTNLQVKIKCQVAKSNSQTNGLNFSLQQLQNKIKTCQESRGEKTTVTTEELLSFVQTWKEKLSQRIQYLNCSLDRVSMTELVFTNTILKDQEEDSDILTSSEALEEEAKLDVVTPESFTQLSRVGKPLIEDPAVDVIRKLLQLPNTKWPTHHCDKDPSQTGRGAWACGSRGSSEAGAGGAVCSPPVLCSCPGPSSPKGFKRHRCQPENSGKKAVPSASATSAGSFTPHPKPNKMERKYRVLGDKPPPAAEDFKGIILTLLWESSENLLTVAEEFYRKEKRPVTRPDCMCDTFDQCAENISKKILEYQSQANKYHNSCLIELRIQIRRFEELLPQVCWLVMENFKEHHWKKFFTSVKEIRGQFEEQQKRLEKRKDKNAQKLHLNLGHPVHFQEMESLHLSEEERQEELDSMIRMNKEKLEECTRRNGQVFITNLATFTEKFLLQLDEVVTIDDVQVARMEPPKQKLSMLIRRKLAGLSLKEESEKPLIERGSRKWPGIKPTEVTIQNKILLQPTSSISTTKTTLGHLAAVEARDAVYLKYLASFEEELKRIQDDCTSQIKEAQRWKDSWKQSLHTIQGLYV

SEQ ID NO: 18484 - protein, 508 aa, Homo sapiens
  Payload ID: 3699
  Gene Symbol: CCDC181
  Gene Name: coiled-coil domain containing 181
  Uniprot ID: Q5TID7
  ENSP ID: ENSP00000356779
MNENKDTDSKKSEEYEDDFEKDLEWLINENEKSDASIIEMACEKEENINQDLKENETVMEHTKRHSDPDKSLQDEVSPRRNDIISVPGIQPLDPISDSDSENSFQESKLESQKDLEEEEDEEVRRYIMEKIVQANKLLQNQEPVNDKRERKLKFKDQLVDLEVPPLEDTTTFKNYFENERNMFGKLSQLCISNDFGQEDVLLSLTNGSCEENKDRTILVERDGKFELLNLQDIASQGFLPPINNANSTENDPQQLLPRSSNSSVSGTKKEDSTAKIHAVTHSSTGEPLAYIAQPPLNRKTCPSSAVNSDRSKGNGKSNHRTQSAHISPVTSTYCLSPRQKELQKQLEEKREKLKREEERRKIEEEKEKKRENDIVFKAWLQKKREQVLEMRRIQRAKEIEDMNSRENRDPQQAFRLWLKKKHEEQMKERQTEELRKQEECLFFLKGTEGRERAFKQWLRRKRMEKMAEQQAVRERTRQLRLEAKRSKQLQHHLYMSEAKPFRFTDHYN

SEQ ID NO: 18485 - protein, 509 aa, Homo sapiens
  Payload ID: 3699
  Gene Symbol: CCDC181
  Gene Name: coiled-coil domain containing 181
  Uniprot ID: Q5TID7
  ENSP ID: ENSP00000356780
MNENKDTDSKKSEEYEDDFEKDLEWLINENEKSDASIIEMACEKEENINQDLKENETVMEHTKRHSDPDKSLQDEVSPRRNDIISVPGIQPLDPISDSDSENSFQESKLESQKDLEEEEDEEVRRYIMEKIVQANKLLQNQEPVNDKRERKLKFKDQLVDLEVPPLEDTTTFKNYFENERNMFGKLSQLCISNDFGQEDVLLSLTNGSCEENKDRTILVERDGKFELLNLQDIASQGFLPPINNANSTENDPQQLLPRSSNSSVSGTKKEDSTAKIHAVTHSSTGEPLAYIAQPPLNRKTCPSSAVNSDRSKGNGKSNHRTQSAHISPVTSTYCLSPRQKELQKQLEEKREKLKREEERRKIEEEKEKKRENDIVFKAWLQKKREQVLEMRRIQRAKEIEDMNSRQENRDPQQAFRLWLKKKHEEQMKERQTEELRKQEECLFFLKGTEGRERAFKQWLRRKRMEKMAEQQAVRERTRQLRLEAKRSKQLQHHLYMSEAKPFRFTDHYN

SEQ ID NO: 18486 - protein, 356 aa, Homo sapiens
  Payload ID: 3699
  Gene Symbol: CCDC181
  Gene Name: coiled-coil domain containing 181
  ENSP ID: ENSP00000411000
MNENKDTDSKKSEEYEDDFEKDLEWLINENEKSDASIIEMACEKEENINQDLKENETVMEHTKRHSDPDKSLQDEVSPRRNDIISVPGIQPLDPISDSDSENSFQESKLESQKDLEEEEDEEVRRYIMEKIVQANKLLQNQEPVNDKRERKLKFKDQLVDLEVPPLEDTTTFKNYFENERNMFGKLSQLCISNDFGQEDVLLSLTNGSCEENKDRTILVERDGKFELLNLQDIASQGFLPPINNANSTENDPQQLLPRSSNSSVSGTKKEDSTAKIHAVTHSSTGEPLAYIAQPPLNRKTCPSSAVNSDRSKGNGKSNHRTQSAHISPVTSTYCLSPRQKELQKQLEEKREKLKRE

SEQ ID NO: 18487 - protein, 508 aa, Homo sapiens; identical to SEQ ID NO: 18484
  Payload ID: 3699
  Gene Symbol: CCDC181
  Gene Name: coiled-coil domain containing 181
  Uniprot ID: Q5TID7
  ENSP ID: ENSP00000442297

SEQ ID NO: 18488 - protein, 418 aa, Homo sapiens
  Payload ID: 3699
  Gene Symbol: CCDC181
  Gene Name: coiled-coil domain containing 181
  Uniprot ID: Q5TID7
  ENSP ID: ENSP00000479042
MNENKDTDSKKSEEYEDDFEKDLEWLINENEKSDASIIEMACEKEENINQDLKENETVMEHTKRHSDPDKSLQDEVSPRRNDIISVPGIQPLDPISDSDSENSFQESKLESQKDLEEEEDEEVRRYIMEKIVQANKLLQNQEPVNDKRERKLKFKDQLVDLEVPPLEDTTTFKNYFENERNMFGKLSQLCISNDFGQEDVLLSLTNGSCEENKDRTILVERDGKFELLNLQDIASQGFLPPINNANSTENDPQQLLPRSSNSSVSGTKKEDSTAKIHAVTHSSTGEPLAYIAQPPLNRKTCPSSAVNSDRSKGNGKSNHRTQSAHISPVTSTYCLSPRQKELQKQLEEKREKLKREEERRKIEEEKEKKRENDIVFKAWLQKKREQVLEMRRIQRAKEIEDMNSRVSKTSLKNKFIQI

SEQ ID NO: 18489 - protein, 153 aa, Homo sapiens
  Payload ID: 3700
  Gene Symbol: CCDC182
  Gene Name: coiled-coil domain containing 182
  Uniprot ID: A6NF36
  ENSP ID: ENSP00000299415
MEPLYQAGSILMTVNTLQGKKMIESGLQSGDFSLSQSWPSCLPPPADLEILQQKVAGVQRELEDFKKEALKSIHYLEDAFCEMNGALVQQEEQAARVRQRLREEEDRGIVRNKVLTFLLPREKQLREHCKRLEDLLLDRGRDALRATKKSQAD

SEQ ID NO: 18490 - protein, 534 aa, Homo sapiens
  Payload ID: 3701
  Gene Symbol: CCDC183
  Gene Name: coiled-coil domain containing 183
  Uniprot ID: Q5T5S1
  ENSP ID: ENSP00000338013
MRRHSETDVEEQTQELKTITQLQEQCRALQIQGVKENMDQNKATLALLRSNIRRGAQDWALAKKYDQWTISKACGKNLPLRLAHCRSTMEVVREKLRKYVFDRVNMHNLLIHLVRRRGQKLESMQLELDSLRSQPDASKEELRLLQIIRQLENNIEKTMIKIITSQNIHLLYLDLLDYLKTVLAGYPIELDKLQNLVVNYCSELSDMKIMSQDAMMITDEVKRNMRQREASFIEERRARENRLNQQKKLIDKIHTKETSEKYRRGQMDLDFPSNLMSTETLKLRRKETSTAEMEYQSGVTAVVEKVKSAVRCSHVWDITSRFLAQRNTEENLELQMEDCEEWRVQLKALVKQLELEEAVLKFRQKPSSISFKSVEKKMTDMLKEEEERLQLAHSNMTKGQELLLTIQMGIDNLYVRLMGINLPATQREVVLSNTLDLNSKLAYCEGKLTYLADRVQMVSRTEEGDTKVRDTLESSTLMEKYNTRISFENREEDMIDTFQFPDMDHSYVPSRAEIKRQAQRLIEGKLKAAKKKKK

SEQ ID NO: 18491 - protein, 318 aa, Homo sapiens
  Payload ID: 3701
  Gene Symbol: CCDC183
  Gene Name: coiled-coil domain containing 183
  ENSP ID: ENSP00000419222
MRRHSETDVEEQTQELKTITQLQEQCRALQIQGVKENMDQNKATLALLRSNIRRGAQDWALAKKYDQWTISKACGKNLPLRLAHCRSTMEVVREKLRKYVFDRVNMHNLLIHLVRRRGQKLESMQLELDSLRSQPDASKEELRLLQIIRQLENNIEKTMIKIITSQNIHLLYLDLLDYLKTVLAGYPIELDKLQNLVVNYCSELSDMKIMSQDAMMITDEVKEHEAKGGVLHRGAPGKGEPAQPAEEADRQDPHEGDQREVPPGPDGLGLPLEPDEHGDPEIEEKRDLHSRNGIPVGRDCCGGEGQECCTVLSRLGHH

SEQ ID NO: 18492 - protein, 194 aa, Homo sapiens
  Payload ID: 3702
  Gene Symbol: CCDC184
  Gene Name: coiled-coil domain containing 184
  Uniprot ID: Q52MB2
  ENSP ID: ENSP00000320849
MEDGLLEIMTKDGGDMPAPLEVSTVPAVGDVISGEYNGGMKELMEHLKAQLQALFEDVRAMRGALDEQASHIQVLSDDVCANQRAIVSMCQIMTTAPRQGGLGVVGGKGSFQSDPQEPETPSPGIGDSGLLGRDPEDEEEEEEEKEMPSPATPSSHCERPESPCAGLLGGDGPLVEPLDMPDITLLQLEGEASL

SEQ ID NO: 18493 - protein, 623 aa, Homo sapiens
  Payload ID: 3703
  Gene Symbol: CCDC185
  Gene Name: coiled-coil domain containing 185
  Uniprot ID: Q8N715
  ENSP ID: ENSP00000355840
MAGFSHFSQPPYRDLWEPPRPGGERESTQRLGGQRSGADSTACSRAGTPGAESEAGACWLHPHCSFTPRPRRRGCSDSLRGSRSLSDVARRPLERSRKHRPRSRRLEDAWGETGTKPRPAWQPQTQLPPQRPQPCPHYPLAQGDSPPPCPGGAGTPLSGTFRVEKAQGGDQWAVPLGRHLGRWSPSSVPSERSSVPSQKFKRHSACVCAQKRDSSDQVESLASRDSQPLASSKEMRSPHTQVLKSKLEEVVVSSQDQQIVALVLTRLKKAQRIRELQQQAAKAWEELKRSDQKVQMTLERERRLLLRQSQEQWQEKEQRKTLQSPEQRGLRRDSQRKNVPPGESRWKEQPEDQESPRQEKLEKARAQAEHRKQCQVRRLREQEKMLRNLREQHSLQLQRRLVEACRKRHLHAVEGQKKVQDTNLSSLINYQARKVLMDCQAKAEELLRQLSLEQSFQRSQEIHQGLRKERQRELREKAQKEEEQLQQARWRAGESEEQRKMRKRILVELADEKIRQARSHVHKTTRDKVQHLRELNHLREKNHHILKLKAEKEEKCHIEGIKEAIKKKEQRVQHISQGKDPNFQEFQKLPQASRREERAPPNSSLDQMVLEAQLRACQQNRGY

SEQ ID NO: 18494 - protein, 211 aa, Homo sapiens
  Payload ID: 3704
  Gene Symbol: CCDC186
  Gene Name: coiled-coil domain containing 186
  ENSP ID: ENSP00000358291
MSETDHIASTSSDKNVGKTPELKEDSCNLFSGNESSKLENESKLLSLNTDKTLCQPNEHNNRIEAQENYIPDHGGGEDSCAKTDTGSENSEQIANFPSGNFAKHISKTNETEQKVTQILVELRSSTFPESANEKTYSESPYDTDCTKKFISKIKSVSASEDLLEEIESELLSTEFAEHRVPNGMNKGEHALVLFEKCVQDKYLQQEHIIKK

SEQ ID NO: 18495 - protein, 211 aa, Homo sapiens; identical to SEQ ID NO: 18494
  Payload ID: 3704
  Gene Symbol: CCDC186
  Gene Name: coiled-coil domain containing 186
  ENSP ID: ENSP00000358292

SEQ ID NO: 18496 - protein, 898 aa, Homo sapiens
  Payload ID: 3704
  Gene Symbol: CCDC186
  Gene Name: coiled-coil domain containing 186
  Uniprot ID: Q7Z3E2
  ENSP ID: ENSP00000358293
MSETDHIASTSSDKNVGKTPELKEDSCNLFSGNESSKLENESKLLSLNTDKTLCQPNEHNNRIEAQENYIPDHGGGEDSCAKTDTGSENSEQIANFPSGNFAKHISKTNETEQKVTQILVELRSSTFPESANEKTYSESPYDTDCTKKFISKIKSVSASEDLLEEIESELLSTEFAEHRVPNGMNKGEHALVLFEKCVQDKYLQQEHIIKKLIKENKKHQELFVDICSEKDNLREELKKRTETEKQHMNTIKQLESRIEELNKEVKASRDQLIAQDVTAKNAVQQLHKEMAQRMEQANKKCEEARQEKEAMVMKYVRGEKESLDLRKEKETLEKKLRDANKELEKNTNKIKQLSQEKGRLHQLYETKEGETTRLIREIDKLKEDINSHVIKVKWAQNKLKAEMDSHKETKDKLKETTTKLTQAKEEADQIRKNCQDMIKTYQESEEIKSNELDAKLRVTKGELEKQMQEKSDQLEMHHAKIKELEDLKRTFKEGMDELRTLRTKVKCLEDERLRTEDELSKYKEIINRQKAEIQNLLDKVKTADQLQEQLQRGKQEIENLKEEVESLNSLINDLQKDIEGSRKRESELLLFTERLTSKNAQLQSESNSLQSQFDKVSCSESQLQSQCEQMKQTNINLESRLLKEEELRKEEVQTLQAELACRQTEVKALSTQVEELKDELVTQRRKHASSIKDLTKQLQQARRKLDQVESGSYDKEVSSMGSRSSSSGSLNARSSAEDRSPENTGSSVAVDNFPQVDKAMLIERIVRLQKAHARKNEKIEFMEDHIKQLVEEIRKKTKIIQSYILREESGTLSSEASDFNKVHLSRRGGIMASLYTSHPADNGLTLELSLEINRKLQAVLEDTLLKNITLKENLQTLGTEIERLIKHQHELEQRTKKT

SEQ ID NO: 18497 - protein, 436 aa, Homo sapiens
  Payload ID: 3704
  Gene Symbol: CCDC186
  Gene Name: coiled-coil domain containing 186
  ENSP ID: ENSP00000415344
  MOD_RES (1)..(1): Any amino acid
XRLIREIDKLKEDINSHVIKVKWAQNKLKAEMDSHKETKDKLKETTTKLTQAKEEADQIRKNCQDMIKTYQESEEIKSNELDAKLRVTKGELEKQMQEKSDQLEMHHAKIKELEDLKRTFKEGMDELRTLRTKVKCLEDERLRTEDELSKYKEIINRQKAEIQNLLDKVKTADQLQEQLQRGKQEIENLKEEVESLNSLINDLQKDIEGSRKRESELLLFTERLTSKNAQLQSESNSLQSQFDKVSCSESQLQSQCEQMKQTNINLESRLLKEEELRKEEVQTLQAELACRQTEVKALSTQVEELKDELVTQRRKHASSIKDLTKQLQQARRKLDQVESGSYDKEVSSMGSRSSSSGSLNARSSAEDRSPENTGSSVAVDNFPQVDKAMLIERIVRLQKAHARKNEKIEFMEDHIKQLVEEIRKKTKKIYKHLEQK

SEQ ID NO: 18498 - protein, 965 aa, Homo sapiens
  Payload ID: 3705
  Gene Symbol: CCDC187
  Gene Name: coiled-coil domain containing 187
  ENSP ID: ENSP00000456543
MWSTGPEARDGDSSVSSGRLSCSSGGHDVCVSWKERPPQVLGPQQRPRKSDARLEQLRDKIRAQAWQQGSCASLGTSAPSSASRLHKASTLMLRRKGQEAKNPPPAPECSGFSILSAAERRVEAKASHGQGRELSRVSQHQVPVLREKPKRVKSSSCKREKTPKLPSPRRAAKDKHKDEDSELVGVYAWRKGQALVRSLLGPPPVLRRHHSKDPSRDPALTVDLGDSEKVIAAKCSPVCAQLPDATSAYSDQQVSGNTPSLASFDQPATIQTAMAILQDLRQQIQAGLELAQARKGGQELGPSKRRLQDVAGRGCCRDPNAQSSFSKSPWAMTERKHSSLERARSVHTWEPWSSSTARESCPQRAWGAQGQDRSFQRPESPHERLGHFSQRPWSALAGQACSPQRAWGAQRQGPSSQRPGSPPEKRSPFPQQPWSAVATQPCPRRAWTACETWEDPGPRLRNPLERPSPPAQRPWSSSGVQRAGPQGKGRGIGSPVSAAKHALPRPTGSFPQNPLGKEKDTLRPCPRSRGLLGPSHSSESLREFMRQKAQARRRQALEEKASALRTRELRSRRLQEVYRQQREAVLGRAVPVVSRTTPGIVTFVPSSAQSGGLEASGSLESPVLEWSKVTSGMVLGGQEAPGSFCLCLNRAWNHAETLDPPGMGGPQDGRDAPVLLSASPSLGSLELQDLTTRYLPRGMCIYLDPKEAEHLGTSSSLHLRHKQAQLQALETTAKVLKQRVDSLTAKLQGAEALDTVRDPAVGLLRSCPHSLPAAPTLATPTLATPACPGALGPNWGRGAPGEWVSMQPQPLLPPTYFLDGETLSWGPSWEQQQSVSPRAHCESKPRGFPEEGHVDVKPDKRLQRGVAPFQALSPSAGSSYAGPATLHPIWGSLGLEETPSVGGADSVAPCTPRSCGKGDPADRPWAGWSGGRGIHREHLPLPSTRAWPYGVEKSFSTWRASTPRY

SEQ ID NO: 18499 - protein, 953 aa, Homo sapiens
  Payload ID: 3705
  Gene Symbol: CCDC187
  Gene Name: coiled-coil domain containing 187
  ENSP ID: ENSP00000457438
MPTLVVGTPPTCLGDTPQPCHKNSQRQGPFSHGAPGRAADWKAVAKPRLCAPAAEDDVAALRWPGPSQQPDPPWAAPHVVGSDDLKEPGPWGKACSLPMWSTGPEARDGDSSVSSGRLSCSSGGHDVCVSWKERPPQVLGPQQRPRKSDARLEQLRDKIRAQAWQQGSCASLGTSAPSSASRLHKASTLMLRRKGQEAKNPPPAPECSGFSILSAAERRVEAKASHGQGRELSRVSQHQVPVLREKPKRVKSSSCKREKTPKLPSPRRAAKDKHKDEDSELVGVYAWRKGQALVRSLLGPPPVLRRHHSKDPSRDPALTVDLGDSEKVIAAKCSPVCAQLPDATSAYSDQQVSGNTPSLASFDQPATIQTAMAILQDLRQQIQAGLELAQARKGGQELGPSKRRLQDVAGRGCCRDPNAQSSFSKSPWAMTERKHSSLERARSVHTWEPWSSSTARESCPQRAWGAQGQDRSFQRPESPHERLGHFSQRPWSALAGQACSPQRAWGAQRQGPSSQRPGSPPEKRSPFPQQPWSAVATQPCPRRAWTACETWEDPGPRLRNPLERPSPPAQRPWSSSGVQRAGPQGKGRGIGSPVSAAKHALPRPTGSFPQNPLGKEKDTLRPCPRSRGLLGPSHSSESLREFMRQKAQARRRQALEEKASALRTRELRSRRLQEVYRQQREAVLGRAVPVVSRTTPGIVTFVPSSAQSGGLEASGSLESPVLEWSKVTSGMVLGGQEAPGSFCLCLNRAWNHAETLDPPGMGGPQDGRDAPVLLSASPSLGSLELQDLTTRYLPRGMCIYLDPKEAEHLGTSSSLHLRHKQAQLQALETTAKVLKQRVDSLTAKLQGAEALDTVRDPAVGLLRSCPHSLPAAPTLATPTLATPACPGALGPNWGRGAPGEWVSMQPQPLLPPTYFLDGETLSWGPSWEQQQSVSPRAHCESKPRGVSQAPLLL

SEQ ID NO: 18500 - protein, 1063 aa, Homo sapiens
  Payload ID: 3705
  Gene Symbol: CCDC187
  Gene Name: coiled-coil domain containing 187
  ENSP ID: ENSP00000485393
MPTLVVGTPPTCLGDTPQPCHKNSQRQGPFSHGAPGRAADWKAVAKPRLCAPAAEDDVAALRWPGPSQQPDPPWAAPHVVGSDDLKEPGPWGKACSLPMWSTGPEARDGDSSVSSGRLSCSSGGHDVCVSWKERPPQVLGPQQRPRKSDARLEQLRDKIRAQAWQQGSCASLGTSAPSSASRLHKASTLMLRRKGQEAKNPPPAPECSGFSILSAAERRVEAKASHGQGRELSRVSQHQVPVLREKPKRVKSSSCKREKTPKLPSPRRAAKDKHKDEDSELVGVYAWRKGQALVRSLLGPPPVLRRHHSKDPSRDPALTVDLGDSEKVIAAKCSPVCAQLPDATSAYSDQQVSGNTPSLASFDQPATIQTAMAILQDLRQQIQAGLELAQARKGGQELGPSKRRLQDVAGRGCCRDPNAQSSFSKSPWAMTERKHSSLERARSVHTWEPWSSSTARESCPQRAWGAQGQDRSFQRPESPHERLGHFSQRPWSALAGQACSPQRAWGAQRQGPSSQRPGSPPEKRSPFPQQPWSAVATQPCPRRAWTACETWEDPGPRLRNPLERPSPPAQRPWSSSGVQRAGPQGKGRGIGSPVSAAKHALPRPTGSFPQNPLGKEKDTLRPCPRSRGLLGPSHSSESLREFMRQKAQARRRQALEEKASALRTRELRSRRLQEVYRQQREAVLGRAVPVVSRTTPGIVTFVPSSAQSGGLEASGSLESPVLEWSKVTSGMVLGGQEAPGSFCLCLNRAWNHAETLDPPGMGGPQDGRDAPVLLSASPSLGSLELQDLTTRYLPRGMCIYLDPKEAEHLGTSSSLHLRHKQAQLQALETTAKVLKQRVDSLTAKLQGAEALDTVRDPAVGLLRSCPHSLPAAPTLATPTLATPACPGALGPNWGRGAPGEWVSMQPQPLLPPTYFLDGETLSWGPSWEQQQSVSPRAHCESKPRGFPEEGHVDVKPDKRLQRGVAPFQALSPSAGSSYAGPATLHPIWGSLGLEETPSVGGADSVAPCTPRSCGKGDPADRPWAGWSGGRGIHREHLPLPSTRAWPYGVEKSFSTWRASTPRY

SEQ ID NO: 18501 - protein, 402 aa, Homo sapiens
  Payload ID: 3706
  Gene Symbol: CCDC188
  Gene Name: coiled-coil domain containing 188
  ENSP ID: ENSP00000409542
MEGLKTLGPCGHPHPQCPPTPASSSHGGGLDQPCQGFVGWPCLGPISSAHSVQSQRPFPVPGAGGSGPTVEGEAPGLFLSSQEQRARDTEGPRQGDLEAGLGWGWPLHPGSNQGAPRQGGSIGSGTRPCPCPPLSREGGALASPRVALSQLQCGLLGSAEQSFLQLEQENHSLKRQNQELREQLGALLGPGQQFLPLCPEHSSCTALAWPPDPAGTQPLGNRAPLQLLRRELCQGQEAFVQQSQNELQQIRLCFERKKMVITEVWDNVAEMHMALNNQATGLLNLKKDIRGVLDQMEDIQLEILRERAQCRTRARKEKQMASMSKGRPKLGSSKGLAGQLWLLTLRLLLGALLVWTAAYVYVVNPTPFEGLVPPLLSRATVWKLRALLDPFLRLKVDGFLPF

SEQ ID NO: 18502 - protein, 331 aa, Homo sapiens
  Payload ID: 3707
  Gene Symbol: CCDC189
  Gene Name: coiled-coil domain containing 189
  Uniprot ID: A1A4V9
  ENSP ID: ENSP00000437532
MLNRKTSHFLGMRVQSELEHLSELRREAGKDRSSVHGSAARTRASVRTQWTTAAAAKADEDPGANLFPPPLPRPRICMWKYLDVHSMHQLEKTTNAEMREVLAELLELGCPEQSLRDAITLDLFCHALIFCRQQGFSLEQTSAACALLQDLHKACIATPLGNVEECYRYFTSVLFCHGVRRPPFSIDLFKEEQLLALEDYVVNTYFRHFKLYKYVFTPQVRLDLSLTYMGLQPPKLWPESETEKEESKEMEEQAVTPQKEELETVAPPEPEPSHIHVLRAYIKTQVNKELEQLQGLVEERLKASEERLSSKLTALERPFQLPPGKGKSKTK

SEQ ID NO: 18503 - protein, 177 aa, Homo sapiens
  Payload ID: 3707
  Gene Symbol: CCDC189
  Gene Name: coiled-coil domain containing 189
  Uniprot ID: A1A4V9
  ENSP ID: ENSP00000441164
MLNRKTSHFLGMRVQSELEHLSELRREAGKDRSSVHGSAARTRASVRTQWTTAAAAKADEDPGANLFPPPLPRPRICMWKYLDVHSMHQLEKTTNAEMREVLAELLELGCPEQSLRDAITLDLFCHALIFCRQQGFSLEQTSAACALLQDLHKACIGERGQLPGLSPREKRNRAWHK

SEQ ID NO: 18504 - protein, 145 aa, Homo sapiens
  Payload ID: 3707
  Gene Symbol: CCDC189
  Gene Name: coiled-coil domain containing 189
  ENSP ID: ENSP00000442644
  MOD_RES (1)..(1): Any amino acid
XTPLGNVEECYRYFTSVLFCHGVRRPPFSIDLFKEEQLLALEDYVVNTYFRHFKLYKYVFTPQVRLDLSLTYMGLQPPKLWPESETGHIHVLRAYIKTQVNKELEQLQGLVEERLKASEERLSSKLTALERPFQLPPGKGKSKTK

SEQ ID NO: 18505 - protein, 71 aa, Homo sapiens
  Payload ID: 3707
  Gene Symbol: CCDC189
  Gene Name: coiled-coil domain containing 189
  ENSP ID: ENSP00000442648
MLNRKTSHFLGMRVQSELEHLSELRREAGKDRSSVHGSAARTRASVRTQWTTAAAAKADEDPGANLFPSLR

SEQ ID NO: 18506 - protein, 91 aa, Homo sapiens
  Payload ID: 3707
  Gene Symbol: CCDC189
  Gene Name: coiled-coil domain containing 189
  ENSP ID: ENSP00000455034
  MOD_RES (1)..(1): Any amino acid
XAEPEGRHHPGPLLPRAHFLPPAGLLTGADVSGLCPAPGSSQGLYCGLLSASTSSKRNSCWPWKTTWSTLTSATSSSINTSSHPRCGWICL

SEQ ID NO: 18507 - protein, 396 aa, Homo sapiens
  Payload ID: 3707
  Gene Symbol: CCDC189
  Gene Name: coiled-coil domain containing 189
  ENSP ID: ENSP00000457287
MLNRKTSHFLGMRVQSELEHLSELRREAGKDRSSVHGSAARTRASVRTQWTTAAAAKADEDPGANLFPPPLPRPRICMWKYLDVHSMHQLEKTTNAEMREVLAELLELGCPEQSLRDAITLDLFCHALIFCRQQGFSLEQTSAACALLQDLHKACIATPLGNVEECYRYFTSVLFCHGVRVSSPGTFWKLYPSPDKVSPSLSHIHHPYLLVKTPVGSPCSCCWAFGGKARAPEGSQGSNSESPPQRPPFSIDLFKEEQLLALEDYVVNTYFRHFKLYKYVFTPQVRLDLSLTYMGLQPPKLWPESETEKEESKEMEEQAVTPQKEELETVAPPEPEPSHIHVLRAYIKTQVNKELEQLQGLVEERLKASEERLSSKLTALERPFQLPPGKGKSKTK

SEQ ID NO: 18508 - protein, 302 aa, Homo sapiens
  Payload ID: 3708
  Gene Symbol: CCDC190
  Gene Name: coiled-coil domain containing 190
  Uniprot ID: Q86UF4
  ENSP ID: ENSP00000356886
MERHMVRGQLYKHFDLERKNAKQAEARLDQRLQRLKVICLYHVKLLTWEQRQLQKELQRLQQAETMKKKFSSYLGNGFQKRPEDVLVFSPQGRQKHRAPQAKKMRALATRMAQDTCKSKSQVPPSHDAGLKDPMKSKKQPLSQNNRTACFIKEQPQAQEKDSVNPSKDVDPSKGISVPCQNQEVSTNTIEQGPSSSPASDSGMACADETRSKDVALKPDGNTGKQIPPKHMECAGSFEGEFTKPTFLELLSKARNAHYLRHRVPPESERLLSIGEIFGHGESSSSRAGKECENRVPSKFLPL

SEQ ID NO: 18509 - protein, 302 aa, Homo sapiens; identical to SEQ ID NO: 18508
  Payload ID: 3708
  Gene Symbol: CCDC190
  Gene Name: coiled-coil domain containing 190
  Uniprot ID: Q86UF4
  ENSP ID: ENSP00000356887

SEQ ID NO: 18510 - protein, 207 aa, Homo sapiens
  Payload ID: 3708
  Gene Symbol: CCDC190
  Gene Name: coiled-coil domain containing 190
  Uniprot ID: Q86UF4
  ENSP ID: ENSP00000356888
MERHMVRGQLYKHFDLERKNAKQAEARLDQRLQRLKVICLYHVKLLTWEQRQLQKELQRLQQETMKKKFSSYLGNGFQKRPEDVLVFSPQGRQKHRAPQAKKMRALATRMAQDTCKSKSQVPPSHDAGLKDPMKSKKQPLSQNNRTACFIKEQPQAQEKDSVNPSKDVDPSKGISVPCQNQEVSTNTIEQGPSSSPASGLQWGDNTL

SEQ ID NO: 18511 - protein, 936 aa, Homo sapiens
  Payload ID: 3709
  Gene Symbol: CCDC191
  Gene Name: coiled-coil domain containing 191
  Uniprot ID: Q8NCU4
  ENSP ID: ENSP00000295878
MLLAPQGRSFSKKRMGLNRWKRFTRKPSPKPTFGPDSVEHWIKRVEKASEFAVSNAFFTRNSDLPRSPWGQITDLKTSEQIEDHDEIYAEAQELVNDWLDTKLKQELASEEEGDAKNTVSSVTIMPEANGHLKYDKFDDLCGYLEEEEESTTVQKFIDHLLHKNVVDSAMMEDLGRKENQDKKQQKDPRLTMEMRHKQVKENRLRREKELEYQRIEKTLKKSAFLEAQCLVQEEKKRKALEAKKEEEEIQREMVKLRREIIERRRTVKAAWKIEKKRQEENSQNSSEKVMFQSTHILPDEEKMVKERKRKLKEVLIQTFKENQQCQKRYFAAWHKLILDHRIKLGKAGTLSDWKIQLKVLRAWRDYTRFQKLERETQALENDLREENRKQQLATEYNRKQVLRHCFTEWQHWHGAELLKRELALTKEETRKKMDALLQAASLGKLSANGLSGISLPEEATAMVGPPVKNGQETAVPPLWEKPPLGSSGCMLSPPLGRTTTGNLQGSLQNVSLSAPGNKQHKTLGAEPSQQPGSNETLRTTSQKAEPLCLGHFHNRHVFQQQLIEKQKKKLQEQQKTILELKKNLQLAEAQWAAEHALAVTEAQSHLLSKPREEEPRTCQMLVNSPVASPGTEGRSDSRNSLSGLRRKPKQLMTPHPILKAMEERAIQRAECRRILAEKKKKQEEEKLAQLKAQEEERQKREAEEKEAQLERKREEKRLKKMKELEKQKRIKRNQQLEAIAKEHYERVLLRKKGLEPWKRLRMQSKQNIQVAEEHYSLFLQRKYMLTWFQRSQESLARKMAQADQFYSQILLKRVIQSWLQYVIDLQEEVRKFCVHFLQKKIFRAWFNMVREVKIDSQGKHEIAAEHSDRRILWITLRTWKKFVKFMKEERVKEERRQQLRRKVVEILPDFQVPGRYHELYQQSDTWSLSKTSLVNE

SEQ ID NO: 18512 - protein, 609 aa, Homo sapiens
  Payload ID: 3709
  Gene Symbol: CCDC191
  Gene Name: coiled-coil domain containing 191
  ENSP ID: ENSP00000418099
MLLAPQGRSFSKKRMGLNRWKRFTRKPSPKRVEKASEFAVSNAFFTRNSDLPRSPWGQITDLKTSEQIEDHDEIYAEAQELVNDWLDTKLKQELASEEEGDAKNTVSSVTIMPEANGHLKYDKFDDLCGYLEEEEESTTVQKFIDHLLHKNVVDSAMMEDLGRKENQDKKQQKDPRLTMEMRHKQVKENRLRREKELEYQRIEKTLKKSAFLEAQCLVQEEKKRKALEAKKEEEEIQREMVKLRREIIERRRTVKAAWKIEKKRQEENSQNSSEKVMFQSTHILPDEEKMVKERKRKLKEVLIQTFKENQQCQKRYFAAWHKLILDHRIKLGKAGTLSDWKIQLKVLRAWRDYTRFQKLERETQALENDLREENRKQQLATEYNRKQVLRHCFTEWQHWHGAELLKRELALTKEETRKKMDALLQAASLGKLSANGLSGISLPEEATAMVGPPVKNGQETAVPPLWEKPPLGSSGCMLSPPLGRTTTGNLQGSLQNVSLSAPGNKQHKTLGAEPSQQPGSNETLRTTSQKAEPLCLGHFHNRHVFQQQLIEKQKKKLQEQQKTILELKKNLQLAEAQWAAEHALAVTEAQSHLLSKPREEEPRTCQMLV

SEQ ID NO: 18513 - protein, 81 aa, Homo sapiens
  Payload ID: 3709
  Gene Symbol: CCDC191
  Gene Name: coiled-coil domain containing 191
  ENSP ID: ENSP00000418382
MLLAPQGRSFSKKRMGLNRWKRFTRKPSPKRVEKASEFAVSNAFFTRNSDLPRSPWGQITDLKTSEQIEDHDEIYAEGAGQ

SEQ ID NO: 18514 - protein, 197 aa, Homo sapiens
  Payload ID: 3709
  Gene Symbol: CCDC191
  Gene Name: coiled-coil domain containing 191
  ENSP ID: ENSP00000418991
VTRRQPGQKGGCCSFGRGSGSNLENAPGASGKVLLKEKDGAESLETVHKEAESQAQELVNDWLDTKLKQELASEEEGDAKNTVSSVTIMPEANGHLKYDKFDDLCGYLEEEEESTTVQKFIDHLLHKNVVDSAMMEDLGRKENQDKKQQKDPRLTMEMRHKQVKENRLRREKELEYQRIEKTLKKSAFLEAQCLVQE

SEQ ID NO: 18515 - protein, 38 aa, Homo sapiens
  Payload ID: 3709
  Gene Symbol: CCDC191
  Gene Name: coiled-coil domain containing 191
  ENSP ID: ENSP00000419159
MLLAPQGRSFSKKRMGLNRWKRFTRKPSPKLRSWSMTG

SEQ ID NO: 18516 - protein, 627 aa, Homo sapiens
  Payload ID: 3710
  Gene Symbol: CCDC22
  Gene Name: coiled-coil domain containing 22
  Uniprot ID: O60826
  ENSP ID: ENSP00000365401
MEEADRILIHSLRQAGTAVPPDVQTLRAFTTELVVEAVVRCLRVINPAVGSGLSPLLPLAMSARFRLAMSLAQACMDLGYPLELGYQNFLYPSEPDLRDLLLFLAERLPTDASEDADQPAGDSAILLRAIGSQIRDQLALPWVPPHLRTPKLQHLQGSALQKPFHASRLVVPELSSRGEPREFQASPLLLPVPTQVPQPVGRVASLLEHHALQLCQQTGRDRPGDEDWVHRTSRLPPQEDTRAQRQRLQKQLTEHLRQSWGLLGAPIQARDLGELLQAWGAGAKTGAPKGSRFTHSEKFTFHLEPQAQATQVSDVPATSRRPEQVTWAAQEQELESLREQLEGVNRSIEEVEADMKTLGVSFVQAESECRHSKLSTAEREQALRLKSRAVELLPDGTANLAKLQLVVENSAQRVIHLAGQWEKHRVPLLAEYRHLRKLQDCRELESSRRLAEIQELHQSVRAAAEEARRKEEVYKQLMSELETLPRDVSRLAYTQRILEIVGNIRKQKEEITKILSDTKELQKEINSLSGKLDRTFAVTDELVFKDAKKDDAVRKAYKYLAALHENCSQLIQTIEDTGTIMREVRDLEEQIETELGKKTLSNLEKIREDYRALRQENAGLLGRVREA

SEQ ID NO: 18517 - protein, 307 aa, Homo sapiens
  Payload ID: 3711
  Gene Symbol: CCDC24
  Gene Name: coiled-coil domain containing 24
  Uniprot ID: Q8N4L8
  ENSP ID: ENSP00000361392
MLRHSPSLWELVEEHVPLRERREVKRILGEAAVDLSLELRAEVAMLRALLQEARSSQAPSSRPISDPSSLLAPPPLLKDLLRQELRQLLQGLRHKAICEGRDQAQAWVQYSPRVLHFALEEPRCDLPEQEIFQMRGGGPSSGHRDLSIIKDQLNVSNIDQVARHLRGLLEEECHTLEREILILQRCLEEEYLRPCHPSEAALEPTLAELKEQKKAMEQELQASVGPSCVSPNHRQRPLGSSTQGLRPPLPLCGVAPLQCCLPAPPLEPYLRPRGQSATHRWGRQLQCSPREGPASTPMSSAAPQAPA

SEQ ID NO: 18518 - protein, 96 aa, Homo sapiens
  Payload ID: 3711
  Gene Symbol: CCDC24
  Gene Name: coiled-coil domain containing 24
  ENSP ID: ENSP00000476285
MLRHSPSLWELVEEHVPLRERREVKRILGEAAVDLSLELRAEPPPFRTLPSPVARYPSSPCRWRCYGHCSKRLDPLKPPAPAPSLTPLLFWHHRLS

SEQ ID NO: 18519 - protein, 59 aa, Homo sapiens
  Payload ID: 3711
  Gene Symbol: CCDC24
  Gene Name: coiled-coil domain containing 24
  ENSP ID: ENSP00000476322
MLRHSPSLWELVEEHVPLRERREVKRILGEAAVDLSLELRAERSQRSQHHQGPTERVQH

SEQ ID NO: 18520 - protein, 220 aa, Homo sapiens
  Payload ID: 3711
  Gene Symbol: CCDC24
  Gene Name: coiled-coil domain containing 24
  ENSP ID: ENSP00000476456
MLRHSPSLWELVEEHVPLRERREVKRILGEAAVDLSLELRAEKQLPRSDIWVLKAWGEQHAESDSDFIASSGHRDLSIIKDQLNVSNIDQVARHLRGLLEEECHTLEREILILQRCLEEEYLRPCHPSEAALEPTLAELKEQKKAMEQELQASVGPSCVSPNHSGPWGPPHRASDPRFPSAGLHLSSAACLHLLWSPTFDLEASRLPTAGDGSFSAAPGK

SEQ ID NO: 18521 - protein, 65 aa, Homo sapiens
  Payload ID: 3711
  Gene Symbol: CCDC24
  Gene Name: coiled-coil domain containing 24
  ENSP ID: ENSP00000476589
MLRHSPSLWELVEEHVPLRERREVKRILGEAAVDLSLELRAEVGRGKQRSQRSQHHQGPTERVQH

SEQ ID NO: 18522 - protein, 96 aa, Homo sapiens; identical to SEQ ID NO: 18518
  Payload ID: 3711
  Gene Symbol: CCDC24
  Gene Name: coiled-coil domain containing 24
  ENSP ID: ENSP00000476661

SEQ ID NO: 18523 - protein, 59 aa, Homo sapiens; identical to SEQ ID NO: 18519
  Payload ID: 3711
  Gene Symbol: CCDC24
  Gene Name: coiled-coil domain containing 24
  ENSP ID: ENSP00000476914

SEQ ID NO: 18524 - protein, 208 aa, Homo sapiens
  Payload ID: 3712
  Gene Symbol: CCDC25
  Gene Name: coiled-coil domain containing 25
  Uniprot ID: Q86WR0
  ENSP ID: ENSP00000348933
MVFYFTSSSVNSSAYTIYMGKDKYENEDLIKHGWPEDIWFHVDKLSSAHVYLRLHKGENIEDIPKEVLMDCAHLVKANSIQGCKMNNVNVVYTPWSNLKKTADMDVGQIGFHRQKDVKIVTVEKKVNEILNRLEKTKVERFPDLAAEKECRDREERNEKKAQIQEMKKREKEEMKKKREMDELRSYSSLMKVENMSSNQDGNDSDEFM

SEQ ID NO: 18525 - protein, 42 aa, Homo sapiens
  Payload ID: 3712
  Gene Symbol: CCDC25
  Gene Name: coiled-coil domain containing 25
  ENSP ID: ENSP00000427714
MVFYFTSSSVNSSAYTIYMGKDKYENEDLIKHGWPEDIWERI

SEQ ID NO: 18526 - protein, 140 aa, Homo sapiens
  Payload ID: 3712
  Gene Symbol: CCDC25
  Gene Name: coiled-coil domain containing 25
  Uniprot ID: Q86WR0
  ENSP ID: ENSP00000428000
MDCAHLVKANSIQGCKMNNVNVVYTPWSNLKKTADMDVGQIGFHRQKDVKIVTVEKKVNEILNRLEKTKVERFPDLAAEKECRDREERNEKKAQIQEMKKREKEEMKKKREMDELRSYSSLMKVENMSSNQDGNDSDEFM

SEQ ID NO: 18527 - protein, 26 aa, Homo sapiens
  Payload ID: 3712
  Gene Symbol: CCDC25
  Gene Name: coiled-coil domain containing 25
  ENSP ID: ENSP00000428499
MVFYFTSSSVNSSAYTIYMGKDKYES

SEQ ID NO: 18528 - protein, 92 aa, Homo sapiens
  Payload ID: 3712
  Gene Symbol: CCDC25
  Gene Name: coiled-coil domain containing 25
  ENSP ID: ENSP00000428505
MVFYFTSSSVNSSAYTIYMGKDKYENEDLIKHGWPEDIWFHVDKLSSAHVYLRLHKGENIEDIPKEVLMDCAHLVKANSIQGKNCDSGEESK

SEQ ID NO: 18529 - protein, 42 aa, Homo sapiens; identical to SEQ ID NO: 18525
  Payload ID: 3712
  Gene Symbol: CCDC25
  Gene Name: coiled-coil domain containing 25
  ENSP ID: ENSP00000428587

SEQ ID NO: 18530 - protein, 86 aa, Homo sapiens
  Payload ID: 3712
  Gene Symbol: CCDC25
  Gene Name: coiled-coil domain containing 25
  ENSP ID: ENSP00000429861
MVFYFTSSSVNSSAYTIYMGKDKYENEDLIKHGWPEDIWFHVDKLSSAHVYLRLHKGENIEDIPKEVLMDCAHLVKANSIQGAIHH

SEQ ID NO: 18531 - protein, 92 aa, Homo sapiens; identical to SEQ ID NO: 18528
  Payload ID: 3712
  Gene Symbol: CCDC25
  Gene Name: coiled-coil domain containing 25
  ENSP ID: ENSP00000430662

SEQ ID NO: 18532 - protein, 656 aa, Homo sapiens
  Payload ID: 3713
  Gene Symbol: CCDC27
  Gene Name: coiled-coil domain containing 27
  Uniprot ID: Q2M243
  ENSP ID: ENSP00000294600
MFEAIFPSTPQARLKRDPREKPGLSSFRSTFRQQSSLGLCIPRLMLPKEASPSQRHSSMSSSMARALVLLQSMASRDARCPEWKPHQKPRTLSKSVQTISRYYRKTSEPKDAASLTGFMSKMELRRVFPTHPDCPQFSTRATSMSHCGSPTEADLSGEIDNSSETWRGTQDLFLARRGSDTNVDGYLLPFSKSICEFDYLRKRRKSQTLSPVTSSSVASQSCLRKRMPWYLSVIHEKDHCLSELEIQVQKKDEEILLLQEEREALKMQLKCLLKGKGQETSMSPGRREQLSDASLKLGRLSLLKAFSRHEEELQHWWQMQEESAAPERGKEPDLGGGEEDEGLEGEPDGVEDTGAWGGVSQMGSVHEEGSEEEEEEEGDRDEDSEERELPEEEEIPRRRASSLAESFEEELLAQLEEYEQVILDFQFNLEATRTRYSLATGVIASLQQQVDFQETQLRKINTENETLQKELRERRQQLQAMTDKFSNLREDKKHQEMMGLIEKDNQLLRQQVSELERKLTKRDCVISELDTKVSQLQEQVELDQNHLQRWKQLQEDLQSKKEMIQQAEQHTRVALESSQSRLERLRNKIIQATFSISGTKSLANEISDNDILEALQRIISERSDYYNQLKQKGVKVPPLQQSEAFLTSKSKKGTSK

SEQ ID NO: 18533 - protein, 202 aa, Homo sapiens
  Payload ID: 3713
  Gene Symbol: CCDC27
  Gene Name: coiled-coil domain containing 27
  ENSP ID: ENSP00000463275
MFEAIFPSTPQARLKRDPREKPGLSSFRSTFRQQSSLGLCIPRLMLPKEASPSQRHSSMSSSMARALVLLQSMASRDARCPEWKPHQKPRTLSKSVQTISRYYRKTSEPKDAASLTGFMSKMELRRVFPTHPDCPQFSTRATSMSHCGSPTEADLSGEIDNSSETWRGTQDLFLARRGSDTNVDVRASASSITCGRGENPRL

SEQ ID NO: 18534 - protein, 274 aa, Homo sapiens
  Payload ID: 3714
  Gene Symbol: CCDC28A
  Gene Name: coiled-coil domain containing 28A
  Uniprot ID: Q8IWP9
  ENSP ID: ENSP00000332716
MPRAEPRATLGEQEKAGLPLGAWRLYLLRHFRKQTELRRSGSRDVTGALLVAAAVASEAVGSLRVAEGGPNTLLLQVLRSWPWCNKELKTMEERKVKRRSPKSFSAHCTQVVNAKKNAIPVSKSTGFSNPASQSTSQRPKLKRVMKEKTKPQGGEGKGAQSTPIQHSFLTDVSDVQEMERGLLSLLNDFHSGKLQAFGNECSIEQMEHVRGMQEKLARLNLELYGELEELPEDKRKTASDSNLDRLLSDLEELNSSIQKLHLADAQDVPNTSAS

SEQ ID NO: 18535 - protein, 274 aa, Homo sapiens; identical to SEQ ID NO: 18534
  Payload ID: 3714
  Gene Symbol: CCDC28A
  Gene Name: coiled-coil domain containing 28A
  Uniprot ID: Q8IWP9
  ENSP ID: ENSP00000479060

SEQ ID NO: 18536 - protein, 161 aa, Homo sapiens
  Payload ID: 3714
  Gene Symbol: CCDC28A
  Gene Name: coiled-coil domain containing 28A
  ENSP ID: ENSP00000479544
MPKNAIPVSKSTGFSNPASQSTSQRPKLKRVMKEKTKPQGGEGKGAQSTPIQHSFLTDVSDVQEMERGLLSLLNDFHSGKLQAFGNECSIEQMEHVRGMQEKLARLNLELYGELEELPEDKRKTASDSNLDRLLSDLEELNSSIQKLHLADAQDVPNTSAS

SEQ ID NO: 18537 - protein, 184 aa, Homo sapiens
  Payload ID: 3714
  Gene Symbol: CCDC28A
  Gene Name: coiled-coil domain containing 28A
  ENSP ID: ENSP00000482946
MEERKVKRRSPKSFSAHCTQVVNAKKNAIPVSKSTGFSNPASQSTSQRPKLKRVMKEKTKPQGGEGKGAQSTPIQHSFLTDVSDVQEMERGLLSLLNDFHSGKLQAFGNECSIEQMEHVRGMQEKLARLNLELYGELEELPEDKRKTASDSNLDRLLSDLEELNSSIQKLHLADAQDVPNTSAS

SEQ ID NO: 18538 - protein, 200 aa, Homo sapiens
  Payload ID: 3715
  Gene Symbol: CCDC28B
  Gene Name: coiled-coil domain containing 28B
  Uniprot ID: Q9BUN5
  ENSP ID: ENSP00000362704
MDDKKKKRSPKPCLAQPAQAPGTLRRVPVPTSHSGSLALGLPHLPSPKQRAKFKRVGKEKCRPVLAGGGSGSAGTPLQHSFLTEVTDVYEMEGGLLNLLNDFHSGRLQAFGKECSFEQLEHVREMQEKLARLHFSLDVCGEEEDDEEEEDGVTEGLPEEQKKTMADRNLDQLLSNLEDLSNSIQKLHLAENAEPEEQSAA

SEQ ID NO: 18539 - protein, 241 aa, Homo sapiens
  Payload ID: 3715
  Gene Symbol: CCDC28B
  Gene Name: coiled-coil domain containing 28B
  Uniprot ID: Q9BUN5
  ENSP ID: ENSP00000413017
MDDKKKKRSPKPCLAQPAQAPGTLRRVPVPTSHSGSLALGLPHLPSPKQRAKFKRVGKEKCRPVLAGGGSGSAGTPLQHSFLTEVTDVYEMEGGLLNLLNDFHSGRLQAFGKECSFEQLEHVREMQEKLARLHFSLDVCGEEEDDEEEEDGVTEGLPEEQKKTMADRNLDQLLSNLEDLSNSMYPFQGTRLCVCVPERSVSSSPALQEYSHTTNFPTSCSPVRFSHRLPKPRYRNLEFPQN

SEQ ID NO: 18540 - protein, 129 aa, Homo sapiens
  Payload ID: 3715
  Gene Symbol: CCDC28B
  Gene Name: coiled-coil domain containing 28B
  ENSP ID: ENSP00000431257
MDDKKKKRSPKPCLAQPAQAPGTLRRVPVPTSHSGSLALGLPHLPSPKQRAKFKRVGKEKCRPVLAGGGSGSAGTPLQHSFLTEVTDVYEMEGGLLNLLNDFHSGRLQAFGEASPAALQPGCVWGGGGR

SEQ ID NO: 18541 - protein, 83 aa, Homo sapiens
  Payload ID: 3715
  Gene Symbol: CCDC28B
  Gene Name: coiled-coil domain containing 28B
  ENSP ID: ENSP00000435036
MDDKKKKRSPKPCLAQPAQAPGTLRRVPVPTSHSGSLALGLPHLPSPKQRAKFKRPLRTQSSLRPSPYPQLCGKKARWVTGIT

SEQ ID NO: 18542 - protein, 270 aa, Homo sapiens
  Payload ID: 3716
  Gene Symbol: CCDC3
  Gene Name: coiled-coil domain containing 3
  Uniprot ID: Q9BQI4
  ENSP ID: ENSP00000368102
MLRQLLLAALCLAGPPAPARACQLPSEWRPLSEGCRAELAETIVYARVLALHPEAPGLYNHLPWQYHAGQGGLFYSAEVEMLCDQAWGSMLEVPAGSRLNLTGLGYFSCHSHTVVQDYSYFFFLRMDENYNLLPHGVNFQDAIFPDTQENRRMFSSLFQFSNCSQGQQLATFSSDWEIQEDSRLMCSSVQKALFEEEDHVKKLQQKVATLEKRNRQLRERVKKVKRSLRQARKKGRHLELANQKLSEKLAAGALPHINARGPVRPPYLRG

SEQ ID NO: 18543 - protein, 145 aa, Homo sapiens
  Payload ID: 3716
  Gene Symbol: CCDC3
  Gene Name: coiled-coil domain containing 3
  Uniprot ID: Q9BQI4
  ENSP ID: ENSP00000368116
MDENYNLLPHGVNFQDAIFPDTQENRRMFSSLFQFSNCSQGQQLATFSSDWEIQEDSRLMCSSVQKALFEEEDHVKKLQQKVATLEKRNRQLRERVKKVKRSLRQARKKGRHLELANQKLSEKLAAGALPHINARGPVRPPYLRG

SEQ ID NO: 18544 - protein, 783 aa, Homo sapiens
  Payload ID: 3717
  Gene Symbol: CCDC30
  Gene Name: coiled-coil domain containing 30
  Uniprot ID: Q5VVM6
  ENSP ID: ENSP00000339280
MSQEKNEMFESEWSKEREREKQLASGLDTAEKALKVESEELQKSKSELICLYNEVHNLPGESESKDHFLIACDLLQRENSELETKVLKLSQEFAQLNHFTLGGKTAPSNLITSENTCKDPESNEPILETEIQSRKEETEELCPKLGERKQKEIPEESVKEGSFPREGQKEEGSQQNRDMKDEEKEQQLTMKPEEIVRLREELSHINQSLLQSQSSGDSSDDSGAQHPSSGEKLKYNQQGEVQQLHQNLHRLQILCNSAENELRYERGQNLDLKQHNSLLQEENIKIKIELKHAQQKLLDSTKMCSSLTAEYKHCQQKIKELELEVLKHTQSIKSQNNLQEKLVQEKSKVADAEEKILDLQRKLEHAHKVCLTDTCISEKQQLEEKIKEATQNEAKVKQQYQEEQQKRKLLYQNVDELHRQVRTLQDKENLLEMTCSQQQSRIQQQEALLKQLENEKRKYDEHVKSNQELSEKLSKLQQEKEALREEYLRLLKLLNVHVRNYNEKHHQQKVKLQKVKYRLTNEVELRDKRINQFEDEIGILQHKIEKEKAIQDQITAQNDTLLLEKRKLQEQVIEQEQLIHSNKWTISSIQSRVLYMDKENKQLQENSLRLTQQIGFLERIIRSIHIRRGENLKEFPVPKWWHRGKLASLPPTKKQKEIYSTEVFTSNNAELQHEDESVPEATEKWKHSEQMETTISDILESEVVNEILPLSNSSFSGKGLVESFASLQETEEIKSKEAMASSKSPEKSPENLVCSQNSEAGYINVASLKETHGIQEQDQKSEL

SEQ ID NO: 18545 - protein, 783 aa, Homo sapiens; identical to SEQ ID NO: 18544
  Payload ID: 3717
  Gene Symbol: CCDC30
  Gene Name: coiled-coil domain containing 30
  Uniprot ID: Q5VVM6
  ENSP ID: ENSP00000340378

SEQ ID NO: 18546 - protein, 783 aa, Homo sapiens; identical to SEQ ID NO: 18544
  Payload ID: 3717
  Gene Symbol: CCDC30
  Gene Name: coiled-coil domain containing 30
  Uniprot ID: Q5VVM6
  ENSP ID: ENSP00000397035

SEQ ID NO: 18547 - protein, 481 aa, Homo sapiens
  Payload ID: 3717
  Gene Symbol: CCDC30
  Gene Name: coiled-coil domain containing 30
  ENSP ID: ENSP00000421479
MCSSLTAEYKHCQQKIKELELEVLKHTQSIKSQNNLQEKLVQEKSKVADAEEKILDLQRKLEHAHKVCLTDTCISEKQQLEEKIKEATQNEAKVKQQYQEEQQKRKLLYQNVDELHRQVRTLQDKENLLEMTCSQQQSRIQQQEALLKQLENEKRKYDEHVKSNQELSEKLSKLQQEKEALREEYLRLLKLLNVHVRNYNEKHHQQKVKLQKVKYRLTNEVELRDKRINQFEDEIGILQHKIEKEKAIQDQITAQNDTLLLEKRKLQEQVIEQEQLIHSNKWTISSIQSRVLYMDKENKQLQENSLRLTQQIGFLERIIRSIHIRRGENLKEFPVPKWWHRGKLASLPPTKKQKEIYSTEVFTSNNAELQHEDESVPEATEKWKHSEQMETTISDILESEVVNEILPLSNSSFSGKGLVESFASLQETEEIKSKEAMASSKSPEKSPENLVCSQNSEAGYINVASLKETHGIQEQDQKSEL

SEQ ID NO: 18548 - protein, 61 aa, Homo sapiens
  Payload ID: 3717
  Gene Symbol: CCDC30
  Gene Name: coiled-coil domain containing 30
  ENSP ID: ENSP00000424339
MSQEKNEMFESEWSKEREREKQLASGLDTAEKALKVESESHGLIARFNFLSCHLGKIYQET

SEQ ID NO: 18549 - protein, 312 aa, Homo sapiens
  Payload ID: 3717
  Gene Symbol: CCDC30
  Gene Name: coiled-coil domain containing 30
  ENSP ID: ENSP00000424370
MSQEKNEMFESEWSKEREREKQLASGLDTAEKALKVESEVLKLSQEFAQLNHFTLGGKTAPSNLITSENTCKDPESNEPILETEIQSRKEETEELCPKLGERKQKEIPEESVKEGSFPREGQKEEGSQQNRDMKDEEKEQQLTMKPEEIVRLREELSHINQSLLQSQSSGDSSDDSGAQHPSSGEKLKYNQQGEVQQLHQNLHRLQILCNSAENELRYERGQNLDLKQHNSLLQEENIKIKIELKHAQQKLLDSTKMCSSLTAEYKHCQQKIKELELEVLKHTQSIKSQNNLQEKLVQEKSKVADAEEKCYS

SEQ ID NO: 18550 - protein, 572 aa, Homo sapiens
  Payload ID: 3717
  Gene Symbol: CCDC30
  Gene Name: coiled-coil domain containing 30
  Uniprot ID: Q5VVM6
  ENSP ID: ENSP00000426711
MIHPPRPPKVLGLQHPSSGEKLKYNQQGEVQQLHQNLHRLQILCNSAENELRYERGQNLDLKQHNSLLQEENIKIKIELKHAQQKLLDSTKMCSSLTAEYKHCQQKIKELELEVLKHTQSIKSQNNLQEKLVQEKSKVADAEEKILDLQRKLEHAHKVCLTDTCISEKQQLEEKIKEATQNEAKVKQQYQEEQQKRKLLYQNVDELHRQVRTLQDKENLLEMTCSQQQSRIQQQEALLKQLENEKRKYDEHVKSNQELSEKLSKLQQEKEALREEYLRLLKLLNVHVRNYNEKHHQQKVKLQKVKYRLTNEVELRDKRINQFEDEIGILQHKIEKEKAIQDQITAQNDTLLLEKRKLQEQVIEQEQLIHSNKWTISSIQSRVLYMDKENKQLQENSLRLTQQIGFLERIIRSIHIRRGENLKEFPVPKWWHRGKLASLPPTKKQKEIYSTEVFTSNNAELQHEDESVPEATEKWKHSEQMETTISDILESEVVNEILPLSNSSFSGKGLVESFASLQETEEIKSKEAMASSKSPEKSPENLVCSQNSEAGYINVASLKETHGIQEQDQKSEL

SEQ ID NO: 18551 - protein, 367 aa, Homo sapiens
  Payload ID: 3718
  Gene Symbol: CCDC33
  Gene Name: coiled-coil domain containing 33
  Uniprot ID: Q8N5R6
  ENSP ID: ENSP00000268082
MGEPGPPSPPAPKAAPGLIDSFSEMNNYRRAMQKMAEDILSLRRQASILEGENRILRSRLAQQEEEEGQGKASEAQNTVSMKQKLLLSELDMKKLRDRVQHLQNELIRKNDREKELLLLYQAQQPQAALLKQYQGKLQKMKALEETVRHQEKVIEKMERVLEDRLQDRSKPPPLNRQQGKPYTGFPMLSASGLPLGSMGENLPVELYSVLLAENAKLRTELDKNRHQQAPIILQQQALPVDPGELGAGGDLTERLQETHGPGHSECTETLPAQDLLSGTSDKFNLLAKLEHAQSRILSLESQLEDSARRWGREKQDLATRLQEQEKGFRHPSNSIIIEQPVSDPPGVAPRGSGGGAGSHRTPKVTGP

SEQ ID NO: 18552 - protein, 333 aa, Homo sapiens
  Payload ID: 3718
  Gene Symbol: CCDC33
  Gene Name: coiled-coil domain containing 33
  Uniprot ID: Q8N5R6
  ENSP ID: ENSP00000325661
MGEPGPPSPPAPKAAPGLIDSFSEMNNYRRAMQKMAEDILSLRRQASILEGENRILRSRLAQQEEEEGQGKASEAQNTVSMKQKLLLSELDMKKLRDRVQHLQNELIRKNDREKELLLLYQAQQPQAALLKQYQGKLQKMKALEETVRHQEKVIEKMERVLEDRLQDRSKPPPLNRQQGKPYTGFPMLSASGLPLGSMGENLPVELYSVLLAENAKLRTELDKNRHQQAPIILQQQALPDLLSGTSDKFNLLAKLEHAQSRILSLESQLEDSARRWGREKQDLATRLQEQEKGFRHPSNSIIIEQPVSDPPGVAPRGSGGGAGSHRTPKVTGP

SEQ ID NO: 18553 - protein, 755 aa, Homo sapiens
  Payload ID: 3718
  Gene Symbol: CCDC33
  Gene Name: coiled-coil domain containing 33
  Uniprot ID: Q8N5R6
  ENSP ID: ENSP00000381795
MGLKNKKNTEDPEEPLIASQSTEPEIGHLSPSKKETIMVTLHGATNLPACKDGSEPWPYVVVKSTSEEKNNQSSKAVTSVTSEPTRAPIWGDTVNVEIQAEDAGQEDVILKVVDNRKKQELLSYKIPIKYLRVFHPYHFELVKPTESGKADEATAKTQLYATVVRKSSFIPRYIGCNHMALEIFLRGVNEPLANNPNPIVVIARVVPNYKEFKVSQANRDLASVGLPITPLSFPIPSMMNFDVPRVSQNGCPQLSKPGGPPEQPLWNQSFLFQGRDGATSFSEDTALVLEYYSSTSMKGSQPWTLNQPLGISVLPLKSRLYQKMLTGKGLDGLHVERLPIMDTSLKTINDEAPTVALSFQLLSSERPENFLTPNNSKALPTLDPKILDKKLRTIQESWSKDTVSSTMDLSTSTPREAEEEPLVPEMSHDTEMNNYRRAMQKMAEDILSLRRQASILEGENRILRSRLAQQEEEEGQGKASEAQNTVSMKQKLLLSELDMKKLRDRVQHLQNELIRKNDREKELLLLYQAQQPQAALLKQYQGKLQKMKALEETVRHQEKVIEKMERVLEDRLQDRSKPPPLNRQQGKPYTGFPMLSASGLPLGSMGENLPVELYSVLLAENAKLRTELDKNRHQQAPIILQQQALPDLLSGTSDKFNLLAKLEHAQSRILSLESQLEDSARRWGREKQDLATRLQEQEKGFRHPSNSIIIEQPSALTHSMDLKQPSELEPLLPSSDSKLNKPLSPQKETANSQQT

SEQ ID NO: 18554 - protein, 333 aa, Homo sapiens; identical to SEQ ID NO: 18552
  Payload ID: 3718
  Gene Symbol: CCDC33
  Gene Name: coiled-coil domain containing 33
  Uniprot ID: Q8N5R6
  ENSP ID: ENSP00000452817

SEQ ID NO: 18555 - protein, 701 aa, Homo sapiens
  Payload ID: 3718
  Gene Symbol: CCDC33
  Gene Name: coiled-coil domain containing 33
  ENSP ID: ENSP00000453542
  MOD_RES (1)..(1): Any amino acid
XLLSYKIPIKYLRVFHPYHFELVKPTESGKADEATAKTQLYATVVRKSSFIPRYIGCNHMALEIFLRGVNEPLANNPNPIVVIARVVPNYKEFKVSQANRDLASVGLPITPLSFPIPSMMNFDVPRVSQNGCPQLSKPGGPPEQPLWNQSFLFQGRDGATSFSEDTALVLEYYSSTSMKGSQPWTLNQPLGISVLPLKSRLYQKMLTGKGLDGLHVERLPIMDTSLKTINDEAPTVALSFQLLSSERPENFLTPNNSKALPTLDPKILDKKLRTIQESWSKDTVSSTMDLSTSTPREAEEEPLVPEMSHDTEMNNYRRAMQKMAEDILSLRRQASILEGENRILRSRLAQQEEEEGQGKASEAQNTVSMKQKLLLSELDMKKLRDRVQHLQNELIRKNDREKELLLLYQAQQPQAALLKQYQGKLQKMKALEETVRHQEKVIEKMERVLEDRLQDRSKPPPLNRQQGKPYTGFPMLSASGLPLGSMGENLPVELYSVLLAENAKLRTELDKNRHQQAPIILQQQALPVDPGELGAGGDLTERLQETHGPGHSECTETLPAQDLLSGTSDKFNLLAKLEHAQSRILSLESQLEDSARRWGREKQDLATRLQEQEKGFRHPSNSIIIEQPPYSLPPAPGASIFGKPRATVDPGGWREEAFQSRGQGDGPLPDPEKKQGHQRPALLGNTREACPFHLPQNIYHV

SEQ ID NO: 18556 - protein, 229 aa, Homo sapiens
  Payload ID: 3719
  Gene Symbol: CCDC34
  Gene Name: coiled-coil domain containing 34
  Uniprot ID: Q96HJ3
  ENSP ID: ENSP00000321563
MWAAGRWGPTFPSSYAGFSADCRPRSRPSSDSCSVPMTGARGQGLEVVRSPSPPLPLSCSNSTRSLLSPLGHQSFQFDEDDGDGEDEEDVDDEEDVDEDAHDSEAKVASLRGMELQGCASTQVESENNQEEQKQVRLPESRLTPWEVWFIGKEKEERDRLQLKALEELNQQLEKRKEMEEREKRKIIAEEKHKEWVQKKNEQVRRGKWIHTLTSLLQNISSYYTSLPRF

SEQ ID NO: 18557 - protein, 373 aa, Homo sapiens
  Payload ID: 3719
  Gene Symbol: CCDC34
  Gene Name: coiled-coil domain containing 34
  Uniprot ID: Q96HJ3
  ENSP ID: ENSP00000330240
MWAAGRWGPTFPSSYAGFSADCRPRSRPSSDSCSVPMTGARGQGLEVVRSPSPPLPLSCSNSTRSLLSPLGHQSFQFDEDDGDGEDEEDVDDEEDVDEDAHDSEAKVASLRGMELQGCASTQVESENNQEEQKQVRLPESRLTPWEVWFIGKEKEERDRLQLKALEELNQQLEKRKEMEEREKRKIIAEEKHKEWVQKKNEQKRKEREQKINKEMEEKAAKELEKEYLQEKAKEKYQEWLKKKNAEECERKKKEKEKEKQQQAEIQEKKEIAEKKFQEWLENAKHKPRPAAKSYGYANGKLTGFYSGNSYPEPAFYNPIPWKPIHMPPPKEAKDLSGRKSKRPVISQPHKSSSLVIHKARSNLCLGTLCRIQR

SEQ ID NO: 18558 - protein, 594 aa, Homo sapiens
  Payload ID: 3720
  Gene Symbol: CCDC36
  Gene Name: coiled-coil domain containing 36
  Uniprot ID: Q8IYA8
  ENSP ID: ENSP00000296449
MNFNVWNIKEMLSIPSGSGNKKSSNWNNNQNDYSSLSDSQFLFGSQFCPENSETLSAPLDFGAHLRHSKQSQQNYLEGEPSIFTKYQTKPQLFGGDIKDGGLFPPPLSVGKSKGLLEQFEEKKKRAKDKCDSETLYNFVSNVRESILRLQTSVEKSEDHLSSRSQSILDSLETVAKTLQETIQAQNDLVFEAVQDKGNMEQAILEMKKRFEARQGEFIEMKSNLKHLEVLVAQQSQEFQQLCEQLGQLNVPSVLAELKRLISVPPVKDSASQTSPPLAQSLNLTRQEKYTSEKPVLWQAQALPAAWNPGMGSLQPGEFDVWGEGAKNDDLQEEAALPAFGSHERNRHVKDKVVQTNCKNWAVTKTGAKNHGSSVPGHKIPSDRDLVSQGASQLTSLEINFSTSIKNACQKYQAQSMFLCDPREHLVIKQKDGTVEMRGKDKKQQPRKAHRAHRGRLIASKQKQIPIQTCKFNSKYQSPQPAISVPQSPFLGQQEPRAQPLHLQCPRSPRKPVCPILGGTVMPNKTVRAVQGRLLQLSRCSSQDNWLLSSSSQGDHQMSWFSDLNLGCSETPLCKEAGKNLLYDLGFDSSDDDGF

SEQ ID NO: 18559 - protein, 594 aa, Homo sapiens; identical to SEQ ID NO: 18558
  Payload ID: 3720
  Gene Symbol: CCDC36
  Gene Name: coiled-coil domain containing 36
  Uniprot ID: Q8IYA8
  ENSP ID: ENSP00000391788

SEQ ID NO: 18560 - protein, 203 aa, Homo sapiens
  Payload ID: 3720
  Gene Symbol: CCDC36
  Gene Name: coiled-coil domain containing 36
  Uniprot ID: Q8IYA8
  ENSP ID: ENSP00000403700
MNFNVWNIKEMLSIPSGSGNKKSSNWNNNQNDYSSLSDSQFLFGSQFCPENSETLSAPLDFGAHLRHSKQSQQNYLEGEPSIFTKYQTKPQLFGGDIKDGGLFPPPLSVGKSKGLLEQFEEKKKRAKDKCDSCRRLWKSLRTISVQEANLFWILWRLWPRHVSASCLRYQQRALVNDEHELSDPSLVSSGEVPHRVSDERMGI

SEQ ID NO: 18561 - protein, 594 aa, Homo sapiens; identical to SEQ ID NO: 18558
  Payload ID: 3720
  Gene Symbol: CCDC36
  Gene Name: coiled-coil domain containing 36
  Uniprot ID: Q8IYA8
  ENSP ID: ENSP00000407837

SEQ ID NO: 18562 - protein, 563 aa, Homo sapiens
  Payload ID: 3721
  Gene Symbol: CCDC38
  Gene Name: coiled-coil domain containing 38
  Uniprot ID: Q502W7
  ENSP ID: ENSP00000345470
MSSNLLPTLNSGGKVKDGSTKEDRPYKIFFRDLFLVKENEMAAKETEKFMNRNMKVYQKTTFSSRMKSHSYLSQLAFYPKRSGRSFEKFGPGPAPIPRLIEGSDTKRTVHEFINDQRDRFLLEYALSTKRNTIKKFEKDIAMRERQLKKAEKKLQDDALAFEEFLRENDQRSVDALKMAAQETINKLQMTAELKKASMEVQAVKSEIAKTEFLLREYMKYGFFLLQMSPKHWQIQQALKRAQASKSKANIILPKILAKLSLHSSNKEGILEESGRTAVLSEDASQGRDSQGKPSRSLTRTPEKKKSNLAESFGSEDSLEFLLDDEMDVDLEPALYFKEPEELLQVLRELEEQNLTLFQYSQDVDENLEEVNKREKVIQDKTNSNIEFLLEQEKMLKANCVREEEKAAELQLKSKLFSFGEFNSDAQEILIDSLSKKITQVYKVCIGDAEDDGLNPIQKLVKVESRLVELCDLIESIPKENVEAIERMKQKEWRQKFRDEKMKEKQRHQQERLKAALEKAVAQPKKKLGRRLVFHSKPPSGNKQQLPLVNETKTKSQEEEYFFT

SEQ ID NO: 18563 - protein, 90 aa, Homo sapiens
  Payload ID: 3721
  Gene Symbol: CCDC38
  Gene Name: coiled-coil domain containing 38
  ENSP ID: ENSP00000447129
  MOD_RES (1)..(1): Any amino acid
XREKVIQDKTNSNIEFLLEQEKMLKANCVREEEKAAELQLKSKLFSFGEFNSDAQEILIDSLSKKITQVYKVCIGDAEDDGLNPIQKLVS

SEQ ID NO: 18564 - protein, 47 aa, Homo sapiens
  Payload ID: 3721
  Gene Symbol: CCDC38
  Gene Name: coiled-coil domain containing 38
  ENSP ID: ENSP00000447966
MSSNLLPTLNSGAVRAMSVLWETDRGAVTSTQEMWRQGYLHSTVKAN

SEQ ID NO: 18565 - protein, 13 aa, Homo sapiens
  Payload ID: 3721
  Gene Symbol: CCDC38
  Gene Name: coiled-coil domain containing 38
  ENSP ID: ENSP00000448644
MSSNLLPTLNSGG

SEQ ID NO: 18566 - protein, 62 aa, Homo sapiens
  Payload ID: 3721
  Gene Symbol: CCDC38
  Gene Name: coiled-coil domain containing 38
  ENSP ID: ENSP00000449001
MAAKETEKFMNRNMKVYQKTTFSSRMKSHSYLSQLAFYPKRSGRSFEKFGPGPAPIPRLIEG

SEQ ID NO: 18567 - protein, 941 aa, Homo sapiens
  Payload ID: 3722
  Gene Symbol: CCDC39
  Gene Name: coiled-coil domain containing 39
  Uniprot ID: Q9UFE4
  ENSP ID: ENSP00000405708
MSSEFLAELHWEDGFAIPVANEENKLLEDQLSKLKDERASLQDELREYEERINSMTSHFKNVKQELSITQSLCKARERETESEEHFKAIAQRELGRVKDEIQRLENEMASILEKKSDKENGIFKATQKLDGLKCQMNWDQQALEAWLEESAHKDSDALTLQKYAQQDDNKIRALTLQLERLTLECNQKRKILDNELTETISAQLELDKAAQDFRKIHNERQELIKQWENTIEQMQKRDGDIDNCALELARIKQETREKENLVKEKIKFLESEIGNNTEFEKRISVADRKLLKCRTAYQDHETSRIQLKGELDSLKATVNRTSSDLEALRKNISKIKKDIHEETARLQKTKNHNEIIQTKLKEITEKTMSVEEKATNLEDMLKEEEKDVKEVDVQLNLIKGVLFKKAQELQTETMKEKAVLSEIEGTRSSLKHLNHQLQKLDFETLKQQEIMYSQDFHIQQVERRMSRLKGEINSEEKQALEAKIVELRKSLEEKKSTCGLLETQIKKLHNDLYFIKKAHSKNSDEKQSLMTKINELNLFIDRSEKELDKAKGFKQDLMIEDNLLKLEVKRTREMLHSKAEEVLSLEKRKQQLYTAMEERTEEIKVHKTMLASQIRYVDQERENISTEFRERLSKIEKLKNRYEILTVVMLPPEGEEEKTQAYYVIKAAQEKEELQREGDCLDAKINKAEKEIYALENTLQVLNSCNNNYKQSFKKVTPSSDEYELKIQLEEQKRAVDEKYRYKQRQIRELQEDIQSMENTLDVIEHLANNVKEKLSEKQAYSFQLSKETEEQKPKLERVTKQCAKLTKEIRLLKDTKDETMEEQDIKLREMKQFHKVIDEMLVDIIEENTEIRIILQTYFQQSGLELPTASTKGSRQSSRSPSHTSLSARSSRSTSTSTSQSSIKVLELKFPASSSLVGSPSRPSSASSSSSNVKSKKSSK

SEQ ID NO: 18568 - protein, 671 aa, Homo sapiens
  Payload ID: 3722
  Gene Symbol: CCDC39
  Gene Name: coiled-coil domain containing 39
  ENSP ID: ENSP00000417960
MSSEFLAELHWEDGFAIPVANEENKLLEDQLSKLKDERASLQDELREYEERINSMTSHFKNVKQELSITQSLCKARERETESEEHFKAIAQRELGRVKDEIQRLENEMASILEKKSDKENGIFKATQKLDGLKCQMNWDQQALEAWLEESAHKDSDALTLQKYAQQDDNKIRALTLQLERLTLECNQKRKILDNELTETISAQLELDKAAQDFRKIHNERQELIKQWENTIEQMQKRDGDIDNCALELARIKQETREKENLVKEKIKFLESEIGNNTEFEKRISVADRKLLKCRTAYQDHETSRIQLKGELDSLKATVNRTSSDLEALRKNISKIKKDIHEETARLQKTKNHNEIIQTKLKEITEKTMSVEEKATNLEDMLKEEEKDVKEVDVQLNLIKGVLFKKAQELQTETMKEKAVLSEIEGTRSSLKHLNHQLQKLDFETLKQQEIMYSQDFHIQQVERRMSRLKGEINSEEKQALEAKIVELRKSLEEKKSTCGLLETQIKKLHNDLYFIKKAHSKNSDEKQSLMTKINELNLFIDRSEKELDKAKGFKQDLMIEDNLLKLEVKRTREMLHSKAEEVLSLEKRKQQLYTAMEERTEEIKVHKTMLASQIRYVDQERENISTEFRERLSKIEKLKNRYEILTVVMLPPEGEEEKTQAYYVIKVMSMS

SEQ ID NO: 18569 - protein, 102 aa, Homo sapiens
  Payload ID: 3722
  Gene Symbol: CCDC39
  Gene Name: coiled-coil domain containing 39
  ENSP ID: ENSP00000418482
  MOD_RES (1)..(1): Any amino acid
XDETMEEQDIKLREMKQFHKVIDEMLVDIIEENTEIRIILQTYFQQSGLELPTASTKGSRQSSRSPSHTSLSARSSRSTSTSTSQSSIKVLELKFPASSSLK

SEQ ID NO: 18570 - protein, 97 aa, Homo sapiens
  Payload ID: 3722
  Gene Symbol: CCDC39
  Gene Name: coiled-coil domain containing 39
  ENSP ID: ENSP00000418702
MNFPSSHSVSSKLSKLKDERASLQDELREYEERINSMTSHFKNVKQELSITQSLCKARERETESEEHFKAIAQRELGRVKDEIQRLENEMASILEKK

SEQ ID NO: 18571 - protein, 67 aa, Homo sapiens
  Payload ID: 3722
  Gene Symbol: CCDC39
  Gene Name: coiled-coil domain containing 39
  ENSP ID: ENSP00000420025
REMKQFHKVIDEMLVDIIEENTEIRIILQTYFQQSGLELPTASTKGSRQSSRSPSHTSLSARNRKKA

SEQ ID NO: 18572 - protein, 579 aa, Homo sapiens
  Payload ID: 3723
  Gene Symbol: CCDC40
  Gene Name: coiled-coil domain containing 40
  Uniprot ID: Q4G0X9
  ENSP ID: ENSP00000269318
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQDLYVDQLTTRAQQLEEDIALFEAQYLAQAEDTRILRKAVSEACTEIDAISVEKRRIMQQWASSLVGMKHRDEAHRAVLEALSVSLERFPSQNINTARSRLSTTWHSAGILLRGSFLPGASRAFASVCYGGAAVDNRIREC

SEQ ID NO: 18573 - protein, 478 aa, Homo sapiens
  Payload ID: 3723
  Gene Symbol: CCDC40
  Gene Name: coiled-coil domain containing 40
  Uniprot ID: Q4G0X9
  ENSP ID: ENSP00000364010
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQGVGDTGAAFIPKTTQGDQVSGRGKKKPGTVVARVSPAEL

SEQ ID NO: 18574 - protein, 1030 aa, Homo sapiens
  Payload ID: 3723
  Gene Symbol: CCDC40
  Gene Name: coiled-coil domain containing 40
  Uniprot ID: Q4G0X9
  ENSP ID: ENSP00000364011
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQDLYVDQLTTRAQQLEEDIALFEAQYLAQAEDTRILRKAVSEACTEIDAISVEKRRIMQQWASSLVGMKHRDEAHRAVLEALRGCQHQAKSTDGEIEAYKKSIMKEEEKNEKLASILNRTETEATLLQKLTTQCLTKQVALQSQFNTYRLTLQDTEDALSQDQLEQMILTEELQAIRQAIQGELELRRKTDAAIREKLQEHMTSNKTTKYFNQLILRLQKEKTNMMTHLSKINGDIAQTTLDITHTSSRLDAHQKTLVELDQDVKKVNELITNSQSEISRRTILIERKQGLINFLNKQLERMVSELGGEEVGPLELEIKRLSKLIDEHDGKAVQAQVTWLRLQQEMVKVTQEQEEQLASLDASKKELHIMEQKKLRVESKIEQEKKEQKEIEHHMKDLDNDLKKLNMLMNKNRCSSEELEQNNRVTENEFVRSLKASERETIKMQDKLNQLSEEKATLLNQLVEAEHQIMLWEKKIQLAKEMRSSVDSEIGQTEIRAMKGEIHRMKKYCRTTQDAHRHVHEQHGTHAGTCTKNTGRAQARARTTRDARGHVHEQHGTRAGTCTNNTGRAQARARTRDARRHVHEHRTHTARA

SEQ ID NO: 18575 - protein, 1142 aa, Homo sapiens
  Payload ID: 3723
  Gene Symbol: CCDC40
  Gene Name: coiled-coil domain containing 40
  Uniprot ID: Q4G0X9
  ENSP ID: ENSP00000380679
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQDLYVDQLTTRAQQLEEDIALFEAQYLAQAEDTRILRKAVSEACTEIDAISVEKRRIMQQWASSLVGMKHRDEAHRAVLEALRGCQHQAKSTDGEIEAYKKSIMKEEEKNEKLASILNRTETEATLLQKLTTQCLTKQVALQSQFNTYRLTLQDTEDALSQDQLEQMILTEELQAIRQAIQGELELRRKTDAAIREKLQEHMTSNKTTKYFNQLILRLQKEKTNMMTHLSKINGDIAQTTLDITHTSSRLDAHQKTLVELDQDVKKVNELITNSQSEISRRTILIERKQGLINFLNKQLERMVSELGGEEVGPLELEIKRLSKLIDEHDGKAVQAQVTWLRLQQEMVKVTQEQEEQLASLDASKKELHIMEQKKLRVESKIEQEKKEQKEIEHHMKDLDNDLKKLNMLMNKNRCSSEELEQNNRVTENEFVRSLKASERETIKMQDKLNQLSEEKATLLNQLVEAEHQIMLWEKKIQLAKEMRSSVDSEIGQTEIRAMKGEIHRMKVRLGQLLKQQEKMIRAMELAVARRETVTTQAEGQRKMDRKALTRTDFHHKQLELRRKIRDVRKATDECTKTVLELEETQRNVSSSLLEKQEKLSVIQADFDTLEADLTRLGALKRQNLSEIVALQTRLKHLQAVKEGRYVFLFRSKQSLVLERQRLDKRLALIATILDRVRDEYPQFQEALHKVSQMIANKLESPGPS

SEQ ID NO: 18576 - protein, 99 aa, Homo sapiens
  Payload ID: 3723
  Gene Symbol: CCDC40
  Gene Name: coiled-coil domain containing 40
  ENSP ID: ENSP00000459489
MVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAY

SEQ ID NO: 18577 - protein, 126 aa, Homo sapiens
  Payload ID: 3723
  Gene Symbol: CCDC40
  Gene Name: coiled-coil domain containing 40
  ENSP ID: ENSP00000460002
MVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRV

SEQ ID NO: 18578 - protein, 85 aa, Homo sapiens
  Payload ID: 3723
  Gene Symbol: CCDC40
  Gene Name: coiled-coil domain containing 40
  ENSP ID: ENSP00000460432
  MOD_RES (1)..(1): Any amino acid
XYTETSSPEGQISAPNGRPAPLPAEPRERHRVLRPGGVRLAGASDPPRGARCPPQGRRPASVPGPDPAAQHRGGGHGRESGVRGE

SEQ ID NO: 18579 - protein, 83 aa, Homo sapiens
  Payload ID: 3723
  Gene Symbol: CCDC40
  Gene Name: coiled-coil domain containing 40
  ENSP ID: ENSP00000461034
  MOD_RES (1)..(1): Any amino acid
XQYLAQAEDTRILRKAVSEACTEIDAISVEKRRIMQQWASSLVGMKHRDEAHRAVLEALRCRSRNQSQLWPGKGSSPCVTRVA

SEQ ID NO: 18580 - protein, 316 aa, Homo sapiens
  Payload ID: 3724
  Gene Symbol: CCDC42
  Gene Name: coiled-coil domain containing 42
  Uniprot ID: Q96M95
  ENSP ID: ENSP00000293845
MSLGIMEEEDLAEYFRLQYGERLLQMLQKLPNVEGASESPSIWLLEKKKETEIMHQTMVQKKKMFQRRMETLNLRWEELGVKEAQLKAHIQKSEQFIQENDQKRIRAMKKANKERELKCQHMQELTKRKQEMVALRLEHQRLSAKLKDYYIFNKYLEKVVENSEFEEIHEVIARYKTLVSMRHDLMQSAQEGQEKIERAKARLARYMEEKDDEILQQNNELARLQMRFDRARSNVIFWESRWAHIQNTAAKKTLLLGTIKMATLNLFQIVSKHLKEVTEVALEDTHKQLDMIQQFIQDRSDIWAEVKKKEQQRVRI

SEQ ID NO: 18581 - protein, 242 aa, Homo sapiens
  Payload ID: 3724
  Gene Symbol: CCDC42
  Gene Name: coiled-coil domain containing 42
  Uniprot ID: Q96M95
  ENSP ID: ENSP00000444359
MSLGIMEEEDLAEYFRLQYGERLLQMLQKLPNVEGASESPSIWLLEKKKETEIMHQTMVQKKKMFQRRMETLNLRWEELGVKEAQLKAHIQKSEQFIQENDQKRIRAMKKANKERELKCQHMQELTKRKQEMVALRLEHQRLSAKLKDYYIFNKYLEKVVENSEESRWAHIQNTAAKKTLLLGTIKMATLNLFQIVSKHLKEVTEVALEDTHKQLDMIQQFIQDRSDIWAEVKKKEQQRVRI

SEQ ID NO: 18582 - protein, 12 aa, Homo sapiens
  Payload ID: 3724
  Gene Symbol: CCDC42
  Gene Name: coiled-coil domain containing 42
  ENSP ID: ENSP00000462524
MSLGIMEEEDLA

SEQ ID NO: 18583 - protein, 224 aa, Homo sapiens
  Payload ID: 3725
  Gene Symbol: CCDC43
  Gene Name: coiled-coil domain containing 43
  Uniprot ID: Q96MW1
  ENSP ID: ENSP00000323782
MAAPSEVAAIAPGEGDGGGGGFGSWLDGRLEALGVDRAVYGAYILGILQEEEEEEKLDALQGILSAFLEEDSLLNICKEIVERWSETQNVVTKVKKEDEVQAIATLIEKQAQIVVKPRMVSEEEKQRKAALLAQYADVTDEEDEADEKDDSGATTMNIGSDKLLFRNTNVEDVLNARKLERDSLRDESQRKKEQDKLQRERDKLAKQERKEKEKKRTQRGERKR

SEQ ID NO: 18584 - protein, 154 aa, Homo sapiens
  Payload ID: 3725
  Gene Symbol: CCDC43
  Gene Name: coiled-coil domain containing 43
  Uniprot ID: Q96MW1
  ENSP ID: ENSP00000400845
MAAPSEVAAIAPGEGDGGGGGFGSWLDGRLEALGVDRAVYGAYILGILQEEEEEEKLDALQGILSAFLEEDSLLNICKEIVERWSETQNVVTKVKKEDEVQAIATLIEKQAQIVVKPRMVSEEEKQRKAALLAQYADVTDEEDSVPKHQCGRCP

SEQ ID NO: 18585 - protein, 227 aa, Homo sapiens
  Payload ID: 3725
  Gene Symbol: CCDC43
  Gene Name: coiled-coil domain containing 43
  ENSP ID: ENSP00000467630
MAAPSEVAAIAPGEGDGGGGGFGSWLDGRLEALGVDRAVYGAYILGILQEEEEEEKLDALQGILSAFLEEDSLLNICKEIVERWSETQNVVTKVKKEDEVQAIATLIEKQAQIVVKPRMVSEEEKQRKAALLAQYADVTDEEESLTEADEKDDSGATTMNIGSDKLLFRNTNVEDVLNARKLERDSLRDESQRKKEQDKLQRERDKLAKQERKEKEKKRTQRGERKR

SEQ ID NO: 18586 - protein, 110 aa, Homo sapiens
  Payload ID: 3725
  Gene Symbol: CCDC43
  Gene Name: coiled-coil domain containing 43
  ENSP ID: ENSP00000468079
  MOD_RES (1)..(1): Any amino acid
XAPGEGDGGGGGFGSWLDGRLEALGVDRAVYGAYILGILQEEEEEEKLDALQGILSAFLEEDSLLNICKEIVERWSETQNVVTKVKKEGTPCLCRLEALTISSFLRDCTM

SEQ ID NO: 18587 - protein, 483 aa, Homo sapiens
  Payload ID: 3726
  Gene Symbol: CCDC47
  Gene Name: coiled-coil domain containing 47
  Uniprot ID: Q96A33
  ENSP ID: ENSP00000225726
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEEAALRREQKKLEKKQMKMKQIKVKAM

SEQ ID NO: 18588 - protein, 483 aa, Homo sapiens; identical to SEQ ID NO: 18587
  Payload ID: 3726
  Gene Symbol: CCDC47
  Gene Name: coiled-coil domain containing 47
  Uniprot ID: Q96A33
  ENSP ID: ENSP00000384888

SEQ ID NO: 18589 - protein, 19 aa, Homo sapiens
  Payload ID: 3726
  Gene Symbol: CCDC47
  Gene Name: coiled-coil domain containing 47
  ENSP ID: ENSP00000462202
MKAFHTFCVVLLVFGSVSE

SEQ ID NO: 18590 - protein, 480 aa, Homo sapiens
  Payload ID: 3726
  Gene Symbol: CCDC47
  Gene Name: coiled-coil domain containing 47
  Uniprot ID: Q96A33
  ENSP ID: ENSP00000463577
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEVRQTYHWGKTTICKDDCLCSVGC

SEQ ID NO: 18591 - protein, 190 aa, Homo sapiens
  Payload ID: 3726
  Gene Symbol: CCDC47
  Gene Name: coiled-coil domain containing 47
  ENSP ID: ENSP00000482148
MDCRTLWPSCQRWEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEEAALRREQKKLEKKQMKMKQIKVKAM

SEQ ID NO: 18592 - protein, 306 aa, Homo sapiens
  Payload ID: 3727
  Gene Symbol: CCDC50
  Gene Name: coiled-coil domain containing 50
  Uniprot ID: Q8IVM0
  ENSP ID: ENSP00000376249
MAEVSIDQSKLPGVKEVCRDFAVLEDHTLAHSLQEQEIEHHLASNVQRNRLVQHDLQVAKQLQEEDLKAQAQLQKRYKDLEQQDCEIAQEIQEKLAIEAERRRIQEKKDEDIARLLQEKELQEEKKRKKHFPEFPATRAYADSYYYEDGGMKPRVMKEAVSTPSRMAHRDQEWYDAEIARKLQEEELLATQVDMRAAQVAQDEEIARLLMAEEKKAYKKAKEREKSSLDKRKQDPEWKPKTAKAANSKSKESDEPHHSKNERPARPPPPIMTDGEDADYTHFTNQQSSTRHFSKSESSHKGFHYKH

SEQ ID NO: 18593 - protein, 482 aa, Homo sapiens
  Payload ID: 3727
  Gene Symbol: CCDC50
  Gene Name: coiled-coil domain containing 50
  Uniprot ID: Q8IVM0
  ENSP ID: ENSP00000376250
MAEVSIDQSKLPGVKEVCRDFAVLEDHTLAHSLQEQEIEHHLASNVQRNRLVQHDLQVAKQLQEEDLKAQAQLQKRYKDLEQQDCEIAQEIQEKLAIEAERRRIQEKKDEDIARLLQEKELQEEKKRKKHFPEFPATRAYADSYYYEDGDQPGSRRARELGSGFSRPCRLQRDGKTVKHKKEKPEHPLENLEEPEQHCSSKRSLSSSSSGKGRDNPHINNEQHERKRSTQERPRRPLLPTISGEVFLSTECDDWETKINHQTRNWEKQSRHQDRLSPKSSQKAGLHCKEVVYGRDHGQGEHRKRRHRPRTPPFSESEEQLHLHDAGMKPRVMKEAVSTPSRMAHRDQEWYDAEIARKLQEEELLATQVDMRAAQVAQDEEIARLLMAEEKKAYKKAKEREKSSLDKRKQDPEWKPKTAKAANSKSKESDEPHHSKNERPARPPPPIMTDGEDADYTHFTNQQSSTRHFSKSESSHKGFHYKH

SEQ ID NO: 18594 - protein, 411 aa, Homo sapiens
  Payload ID: 3728
  Gene Symbol: CCDC51
  Gene Name: coiled-coil domain containing 51
  Uniprot ID: Q96ER9
  ENSP ID: ENSP00000379047
MMGRSPGFAMQHIVGVPHVLVRRGLLGRDLFMTRTLCSPGPSQPGEKRPEEVALGLHHRLPALGRALGHSIQQRATSTAKTWWDRYEEFVGLNEVREAQGKVTEAEKVFMVARGLVREAREDLEVHQAKLKEVRDRLDRVSREDSQYLELATLEHRMLQEEKRLRTAYLRAEDSEREKFSLFSAAVRESHEKERTRAERTKNWSLIGSVLGALIGVAGSTYVNRVRLQELKALLLEAQKGPVSLQEAIREQASSYSRQQRDLHNLMVDLRGLVHAAGPGQDSGSQAGSPPTRDRDVDVLSAALKEQLSHSRQVHSCLEGLREQLDGLEKTCSQMAGVVQLVKSAAHPGLVEPADGAMPSFLLEQGSMILALSDTEQRLEAQVNRNTIYSTLVTCVTFVATLPVLYMLFKAS

SEQ ID NO: 18595 - protein, 302 aa, Homo sapiens
  Payload ID: 3728
  Gene Symbol: CCDC51
  Gene Name: coiled-coil domain containing 51
  Uniprot ID: Q96ER9
  ENSP ID: ENSP00000392898
MVARGLVREAREDLEVHQAKLKEVRDRLDRVSREDSQYLELATLEHRMLQEEKRLRTAYLRAEDSEREKFSLFSAAVRESHEKERTRAERTKNWSLIGSVLGALIGVAGSTYVNRVRLQELKALLLEAQKGPVSLQEAIREQASSYSRQQRDLHNLMVDLRGLVHAAGPGQDSGSQAGSPPTRDRDVDVLSAALKEQLSHSRQVHSCLEGLREQLDGLEKTCSQMAGVVQLVKSAAHPGLVEPADGAMPSFLLEQGSMILALSDTEQRLEAQVNRNTIYSTLVTCVTFVATLPVLYMLFKAS

SEQ ID NO: 18596 - protein, 302 aa, Homo sapiens; identical to SEQ ID NO: 18595
  Payload ID: 3728
  Gene Symbol: CCDC51
  Gene Name: coiled-coil domain containing 51
  Uniprot ID: Q96ER9
  ENSP ID: ENSP00000401194

SEQ ID NO: 18597 - protein, 62 aa, Homo sapiens
  Payload ID: 3728
  Gene Symbol: CCDC51
  Gene Name: coiled-coil domain containing 51
  ENSP ID: ENSP00000408197
MMGRSPGFAMQHIVGVPHVLVRRGLLGRDLFMTRTLCSPGPSQPGEKRPEEVALGLHHRLPA

SEQ ID NO: 18598 - protein, 159 aa, Homo sapiens
  Payload ID: 3728
  Gene Symbol: CCDC51
  Gene Name: coiled-coil domain containing 51
  ENSP ID: ENSP00000409494
MMGRSPGFAMQHIVGVPHVLVRRGLLGRDLFMTRTLCSPGPSQPGEKRPEEVALGLHHRLPALGRALGHSIQQRATSTAKTWWDRYEEFVGLNEVREAQGKVTEAEKVFMVARGLVREAREDLEVHQAKLKEVRDRLDRVSREDSQYLELATLEHRMLQ

SEQ ID NO: 18599 - protein, 302 aa, Homo sapiens; identical to SEQ ID NO: 18595
  Payload ID: 3728
  Gene Symbol: CCDC51
  Gene Name: coiled-coil domain containing 51
  Uniprot ID: Q96ER9
  ENSP ID: ENSP00000412300

SEQ ID NO: 18600 - protein, 194 aa, Homo sapiens
  Payload ID: 3729
  Gene Symbol: CCDC53
  Gene Name: coiled-coil domain containing 53
  Uniprot ID: Q9Y3C0
  ENSP ID: ENSP00000240079
MDEDGLPLMGSGIDLTKVPAIQQKRTVAFLNQFVVHTVQFLNRFSTVCEEKLADLSLRIQQIETTLNILDAKLSSIPGLDDVTVEVSPLNVTSVTNGAHPEATSEQPQQNSTQDSGLQESEVSAENILTVAKDPRYARYLKMVQVGVPVMAIRNKMISEGLDPDLLERPDAPVPDGESEKTVEESSDSESSFSD

SEQ ID NO: 18601 - protein, 50 aa, Homo sapiens
  Payload ID: 3729
  Gene Symbol: CCDC53
  Gene Name: coiled-coil domain containing 53
  ENSP ID: ENSP00000438122
MDEDGLPLMGSGIDLTKVPAIQQKRTVAFLNQFVVHTVQFLNRFSTVCEE

SEQ ID NO: 18602 - protein, 173 aa, Homo sapiens
  Payload ID: 3729
  Gene Symbol: CCDC53
  Gene Name: coiled-coil domain containing 53
  ENSP ID: ENSP00000440134
MDEDGLPLMGSGIDLTKVPAIQQKRTVAFLNQFVVHTVQFLNRFSTVCEEKLADLSLRIQQIETTLNILDAKLSSIPGLDDVTVEVSPLNVTSVTNGAHPEATSEQPQNSTQDSGLQESEVSAENILTVAKDPRYARYLKMVQVGVPVMAIRNKMISEGLDPDLLEKIKKRKK

SEQ ID NO: 18603 - protein, 61 aa, Homo sapiens
  Payload ID: 3729
  Gene Symbol: CCDC53
  Gene Name: coiled-coil domain containing 53
  ENSP ID: ENSP00000440139
MDEDGLPLMGSGIDLTKVPAIQQKRTVAFLNQFVVHTVQFLNRFSTVCEETGSHFVTHAGV

SEQ ID NO: 18604 - protein, 169 aa, Homo sapiens
  Payload ID: 3729
  Gene Symbol: CCDC53
  Gene Name: coiled-coil domain containing 53
  ENSP ID: ENSP00000441810
MDEDGLPLMGSGIDLTKVPAIQQKRTVAFLNQFVVHTVQFLNRFSTVCEEKLADLSLRIQQIETTLNILDAKLSSIPGLDDVTVEVSPLNVTSVTNGAHPEATSEQPQQNSTQDSGLQESEVSAENILTVAKDPRYARYLKMVQVGVPVMAIRNKMISEGLDPDLLEVK

SEQ ID NO: 18605 - protein, 193 aa, Homo sapiens
  Payload ID: 3729
  Gene Symbol: CCDC53
  Gene Name: coiled-coil domain containing 53
  ENSP ID: ENSP00000443857
MDEDGLPLMGSGIDLTKVPAIQQKRTVAFLNQFVVHTVQFLNRFSTVCEEKLADLSLRIQQIETTLNILDAKLSSIPGLDDVTVEVSPLNVTSVTNGAHPEATSEQPQNSTQDSGLQESEVSAENILTVAKDPRYARYLKMVQVGVPVMAIRNKMISEGLDPDLLERPDAPVPDGESEKTVEESSDSESSFSD

SEQ ID NO: 18606 - protein, 107 aa, Homo sapiens
  Payload ID: 3729
  Gene Symbol: CCDC53
  Gene Name: coiled-coil domain containing 53
  ENSP ID: ENSP00000443922
KLADLSLRIQQIETTLNILDAKLSSIPGLDDVTVEVSPLNVTSVTNGAHPEATSEQPQGVPVMAIRNKMISEGLDPDLLERPDAPVPDGESEKTVEESSDSESSFSD

SEQ ID NO: 18607 - protein, 77 aa, Homo sapiens
  Payload ID: 3729
  Gene Symbol: CCDC53
  Gene Name: coiled-coil domain containing 53
  ENSP ID: ENSP00000445501
MDEDGLPLMGSGIDLTKVPAIQQKRTVAFLNQFVVHTVQFLNRFSTVCEETGSCCITEAGVQWRDHSSGQPQLPGLK

SEQ ID NO: 18608 - protein, 328 aa, Homo sapiens
  Payload ID: 3730
  Gene Symbol: CCDC54
  Gene Name: coiled-coil domain containing 54
  Uniprot ID: Q8NEL0
  ENSP ID: ENSP00000261058
MYTLHTKRVKAAARQMWTSNLSKVRQSLKNVYHKCKIRHQDSTGYPTVTSDDCNQDDDSYDGKMNLPVVLQDVKTAQVELFSQMTDIVHMIPKVQEKTDLYQKQMEVLETRMNVNEDKQCTTTKDILSMKEDIKALKKKVTELEIQNSCSTIHCLEILEGERGKEITELLYKLIQPATLKNTLASTDMEISSAEPEKVPSYPKSTDHLEKKTISPQMKTLKKRNHQNASRSFEKAKPNIYIYPDFSTWIKLTFVHGGKWTFFLSATKLEEFIQWLLSRPTILPEEPQVITQRYCPFTGPILSLTTICLSIFNNIYGFICSLKEEVTRL

SEQ ID NO: 18609 - protein, 916 aa, Homo sapiens
  Payload ID: 3731
  Gene Symbol: CCDC57
  Gene Name: coiled-coil domain containing 57
  Uniprot ID: Q2TAC2
  ENSP ID: ENSP00000374292
MLPLGSEPALNELLLRKEEEWRALQAHRTQLQEAALQDTRSQLEEAQGKLRCLQEDFVYNLQVLEERDLELERYDAAFAQAREWEEARRAEVSELKIEAAKLRQALAREARKVEELQQQQQLAFQEHRLELERVHSDKNGEIDHHREQYENLKWTLERKLEELDGELALQRQELLLEFESKMRKREHEFRLQADNMSNTALSRELKVKLLHKELEALKEAGAKAAESLQRAEATNAELERKLQSRAGELQDLEAMSRARVKDLEDKLHSVQLTRKKEEETFKRKHEELDRLAREKDAVLVAVKGAHVEQLQELQTRVLELQAHCETLEAQLRRAEWRQADTAKEKDAAIDQLREDASTVKSAWDAQIAQLSKEMVSRDLQIQTLQEEEVKLKAQVARSQQDIERYKQQLSLAVERERSLERDQVQLGLDWQRRCDDIERDQIQKSEALIQGLSMAKSQVAAKLQETEQALQEQEVVLKAVTLERDQAVQALRMHGLPRPGAQMLLRQHEEEISKDFPSSEIQRLREQNTSLRNAIAQMRKEMEALSHQIPPPIQTAAESTDANQPDPEAGGDAATPDYVLALEAEIRTLKHKFKTLEKHLEDVLDPLKMSSPHAESQPSVRTSTETTGGSAQAGQAGGSVQAGQAGGSVQAGPVSSGLALRKLGDRVQLLNLLVTRLRQKVLREPLEPAALQRELPREVDQVHLEVLELRKQVAELGKHLRIAQHGGAEPSGRKQPPASDAVALGREQDAKSAEDEAPSRHLGKHQPRSAQVGSRLDALQGPKTQHSIHTVTCKSPRQKEDRSPKPPQAPQHPEEHGRQSHSSSSFASGTLQDMWRLLDLGSSPSGVTSQGDSTPELPAPPAADRRPVKMQAGIATPGMKTAAQAKAKTTGASRSHPAKAKGCQRPPKIRNYNIMD

SEQ ID NO: 18610 - protein, 751 aa, Homo sapiens
  Payload ID: 3731
  Gene Symbol: CCDC57
  Gene Name: coiled-coil domain containing 57
  Uniprot ID: Q2TAC2
  ENSP ID: ENSP00000376154
MLPLGSEPALNELLLRKEEEWRALQAHRTQLQEAALQDTRSQLEEAQGKLRCLQEDFVYNLQVLEERDLELERYDAAFAQAREWEEARRAEVSELKIEAAKLRQALAREARKVEELQQQQQLAFQEHRLELERVHSDKNGEIDHHREQYENLKWTLERKLEELDGELALQRQELLLEFESKMRKREHEFRLQADNMSNTALSRELKVKLLHKELEALKEAGAKAAESLQRAEATNAELERKLQSRAGELQDLEAMSRARVKDLEDKLHSVQLTRKKEEETFKRKHEELDRLAREKDAVLVAVKGAHVEQLQELQTRVLELQAHCETLEAQLRRAEWRQADTAKEKDAAIDQLREDASTVKSAWDAQIAQLSKEMVSRDLQIQTLQEEEVKLKAQVARSQQDIERYKQQLSLAVERERSLERDQVQLGLDWQRRCDDIERDQIQKSEALIQGLSMAKSQVAAKLQETEQALQEQEVVLKAVTLERDQAVQALRMHGLPRPGAQMLLRQHEEEISKDFPSSEIQRLREQNTSLRNAIAQMRKEMEALSHQIPPPIQTAAESTDANQPDPEAGGDAATPDYVLALEAEIRTLKHKFKTLEKHLEDVLDPLKMSSPHAESQPSVRTSTETTGGSAQAGQAGGSVQAGQAGGSVQAGPVSSGLALRKLGDRVQLLNLLVTRLRQKVLREPLEPAALQRELPREVDQVHLEVLELRKQVAELGKHLRIAQHGGAEPSGRKQPPASDAVALGREVGAR

SEQ ID NO: 18611 - protein, 212 aa, Homo sapiens
  Payload ID: 3731
  Gene Symbol: CCDC57
  Gene Name: coiled-coil domain containing 57
  ENSP ID: ENSP00000376156
  MOD_RES (1)..(1): Any amino acid
XGKHQPRSAQVGSRLDALQGPKTQHSIHTVTCKSPRQKEDRSPKPPQAPQHPEEHGRQSHSSSSFASGTLQDMWRLLDLGSSPSGVTSQGDSTPGPHSFWNLQTNSIRPSSQCAERQVQKHAPTWGPLPPFWRGSALAPDANLAPCAVQLESNGGAETPWRVTSHTAGAPSSSSSRQEARQDAGRHCHPRDEDSSPGKGQDHRSLPVSSCKS

SEQ ID NO: 18612 - protein, 352 aa, Homo sapiens
  Payload ID: 3731
  Gene Symbol: CCDC57
  Gene Name: coiled-coil domain containing 57
  ENSP ID: ENSP00000376157
MEAEDQGELFLHLRSVARAPQTLSMHRLQRKLKEAARKIISLRLEKEQLIEMGNRLRAELGRPERWLLHHALPPAPEARKPGEEPRRPLDRSPPLGQVQPHFTSQDAKSAEDEAPSRHLGKHQPRSAQVGSRLDALQGPKTQHSIHTVTCKSPRQKEDRSPKPPQAPQHPEEHGRQSHSSSSFASGTLQDMWRLLDLGSSPSGVTSQGDSTPEMGSHYVTQAGLELLGSSSPAALASQSAEMTGVGPTPSLAWSGALHPNMNQEASLVRSTWAPGMRGGMNGGSSSVCKNMQRGPHWSPSQQPCSGIRTVLLSRKERTLLSCFSLPAPVVLVPLLLSGQAVTERAGHAGDIL

SEQ ID NO: 18613 - protein, 916 aa, Homo sapiens; identical to SEQ ID NO: 18609
  Payload ID: 3731
  Gene Symbol: CCDC57
  Gene Name: coiled-coil domain containing 57
  Uniprot ID: Q2TAC2
  ENSP ID: ENSP00000376158

SEQ ID NO: 18614 - protein, 490 aa, Homo sapiens
  Payload ID: 3731
  Gene Symbol: CCDC57
  Gene Name: coiled-coil domain containing 57
  ENSP ID: ENSP00000408124
  MOD_RES (1)..(1): Any amino acid
XPSVRTSTETTGGSAQAGQAGGSVQAGQAGGSVQAGPVSSGLALRKLGDRVQLLNLLVTRLRQKVLREPLEPAALQRELPREVDQVHLEVLELRKQVAELGKHLRIAQHGGAEPSGRKQPPASDAVALGREGLTKRGPMEAEDQGELFLHLRSVARAPQTLSMHRLQRKLKEAARKIISLRLEKEQLIEMGNRLRAELGRPERWLLHHALPPAPEARKPGEEPRRPLDRSPPLGQVQPHFTSQDAKSAEDEAPSRHLGKHQPRSAQVGSRLDALQGPKTQHSIHTVTCKSPRQKEDRSPKPPQAPQHPEEHGRQSHSSSSFASGTLQDMWRLLDLGSSPSGVTSQGDSTPEMGSHYVTQAGLELLGSSSPAALASQSAEMTGVGPTPSLAWSGALHPNMNQEASLVRSTWAPGMRGGMNGGSSSVCKNMQRGPHWSPSQQPCSGIRTVLLSRKERTLLSCFSLPAPVVLVPLLLSGQAVTERAGHAGDIL

SEQ ID NO: 18615 - protein, 35 aa, Homo sapiens
  Payload ID: 3731
  Gene Symbol: CCDC57
  Gene Name: coiled-coil domain containing 57
  ENSP ID: ENSP00000462121
  MOD_RES (1)..(1): Any amino acid
XDKNGEIDHHREQYENLKWTLERKLEELDGTAAGV

SEQ ID NO: 18616 - protein, 45 aa, Homo sapiens
  Payload ID: 3731
  Gene Symbol: CCDC57
  Gene Name: coiled-coil domain containing 57
  ENSP ID: ENSP00000462653
  MOD_RES (1)..(1): Any amino acid
XAADRRPVKMQAGIATPGMKTAAQAKAKTTGASRAGSQMLLRRPC

SEQ ID NO: 18617 - protein, 54 aa, Homo sapiens
  Payload ID: 3731
  Gene Symbol: CCDC57
  Gene Name: coiled-coil domain containing 57
  ENSP ID: ENSP00000463946
EEHGRQSHSSSSFASGTLQDMWRLLDLGSSPSGVTSQGDSTPELHSVLKEAVAA

SEQ ID NO: 18618 - protein, 144 aa, Homo sapiens
  Payload ID: 3732
  Gene Symbol: CCDC58
  Gene Name: coiled-coil domain containing 58
  Uniprot ID: Q4VC31
  ENSP ID: ENSP00000291458
MAAPSGGVNCEEFAEFQELLKVMRTIDDRIVHELNTTVPTASFAGKIDASQTCKQLYESLMAAHASRDRVIKNCIAQTSAVVKNLREEREKNLDDLTLLKQLRKEQTKLKWMQSELNVEEVVNDRSWKVFNERCRIHFKPPKNE

SEQ ID NO: 18619 - protein, 141 aa, Homo sapiens
  Payload ID: 3732
  Gene Symbol: CCDC58
  Gene Name: coiled-coil domain containing 58
  ENSP ID: ENSP00000418810
  MOD_RES (1)..(1): Any amino acid
XKELVSVMDLSLAKELLKVMRTIDDRIVHELNTTVPTASFAGKIDASQTCKQLYESLMAAHASRDRVIKNCIAQTSAVVKNLREEREKNLDDLTLLKQLRKEQTKLKWMQSELNVEEVVNDRSWKVFNERCRIHFKPPKNE

SEQ ID NO: 18620 - protein, 130 aa, Homo sapiens
  Payload ID: 3732
  Gene Symbol: CCDC58
  Gene Name: coiled-coil domain containing 58
  ENSP ID: ENSP00000420248
MWQELLKVMRTIDDRIVHELNTTVPTASFAGKIDASQTCKQLYESLMAAHASRDRVIKNCIAQTSAVVKNLREEREKNLDDLTLLKQLRKEQTKLKWMQSELNVEEVVNDRSWKVFNERCRIHFKPPKNE

SEQ ID NO: 18621 - protein, 53 aa, Homo sapiens
  Payload ID: 3732
  Gene Symbol: CCDC58
  Gene Name: coiled-coil domain containing 58
  ENSP ID: ENSP00000420769
MAAPSGGVNCEEFAEFQLKWMQSELNVEEVVNDRSWKVFNERCRIHFKPPKNE

SEQ ID NO: 18622 - protein, 241 aa, Homo sapiens
  Payload ID: 3733
  Gene Symbol: CCDC59
  Gene Name: coiled-coil domain containing 59
  Uniprot ID: Q9P031
  ENSP ID: ENSP00000256151
MAPVRRSAKWRPGGIEARGEGVSTVGYRNKNVRQKTWRPNHPQAFVGSVREGQGFAFRRKLKIQQSYKKLLRKEKKAQTSLESQFTDRYPDNLKHLYLAEEERHRKQARKVDHPLSEQVHQPLLEEQCSIDEPLFEDQCSFDQPQPEEQCIKTVNSFTIPKKNKKKTSNQKAQEEYEQIQAKRAAKKQEFERRKQEREEAQRQYKKKKMEVFKILNKKTKKGQPNLNVQMEYLLQKIQEKC

SEQ ID NO: 18623 - protein, 181 aa, Homo sapiens
  Payload ID: 3733
  Gene Symbol: CCDC59
  Gene Name: coiled-coil domain containing 59
  ENSP ID: ENSP00000450183
MAPVRRSAKWRPGGIEARGEGVSTVGYRNKNVRQKTWRPNHPQAFVGSVREGQGFAFRRKLKIQQSYKKLLRKEKKAQTSLESQFTDRYPDNLKHLYLAEEERHRKQARKVDHPLSEQVHQPLLEEQCSIDEPLFEDQCSFDQPQPEEQCIKTVKSEFLTCTFSFSLRNVFQHFLQVFGNQ

SEQ ID NO: 18624 - protein, 474 aa, Homo sapiens
  Payload ID: 3734
  Gene Symbol: CCDC6
  Gene Name: coiled-coil domain containing 6
  Uniprot ID: Q16204
  ENSP ID: ENSP00000263102
MADSASESDTDGAGGNSSSSAAMQSSCSSTSGGGGGGGGGGGGGKSGGIVISPFRLEELTNRLASLQQENKVLKIELETYKLKCKALQEENRDLRKASVTIQARAEQEEEFISNTLFKKIQALQKEKETLAVNYEKEEEFLTNELSRKLMQLQHEKAELEQHLEQEQEFQVNKLMKKIKKLENDTISKQLTLEQLRREKIDLENTLEQEQEALVNRLWKRMDKLEAEKRILQEKLDQPVSAPPSPRDISMEIDSPENMMRHIRFLKNEVERLKKQLRAAQLQHSEKMAQYLEEERHMREENLRLQRKLQREMERREALCRQLSESESSLEMDDERYFNEMSAQGLRPRTVSSPIPYTPSPSSSRPISPGLSYASHTVGFTPPTSLTRAGMSYYNSPGLHVQHMGTSHGITRPSPRRSNSPDKFKRPTPPPSPNTQTPVQPPPPPPPPPMQPTVPSAATSQPTPSQHSAHPSSQP

SEQ ID NO: 18625 - protein, 550 aa, Homo sapiens
  Payload ID: 3735
  Gene Symbol: CCDC60
  Gene Name: coiled-coil domain containing 60
  Uniprot ID: Q8IWA6
  ENSP ID: ENSP00000333374
MTKVPATKKLQSSPNSGAVRPFYASENLRQVPDKPMKSIKYMDKEIINLKKDLIRSRFLIQSVKIGRGYFAILREETAKKKKQQQLQKLKEEERNKFQPAEKISEIHYGDTLLSTYDDEKLKTLGARVTRRPFTPIHSCIISPSLTEAHVEPLFRQLCALHWLLEALTIDHTHHTMKPVITCWNPKDPGGSKSTIKKINKDKSMGQKWEHFITAPKTKKFKIPTMRVTNRKPSRRGSTLSLSRASGGSSPQSSMISVNPGSDEPPSVNTQVTSSKDIEDNESSSTKPDEEPLYMNLQKLLEMVREDARRTVTIENGMQRKAPSILSVLKQNKSNSAYKEMQTTLKSSERSSSTSAESHIQPVQKKSKNRTNCDINIHYKSGVCNTMRAKFYSVAQEAGFCLQDKMEILMKRQEERGIQKFRAFVLVSNFQKDIAKMRHHISVVKGDAEEIADHWYFDLLSKLPEDLKNFRPAKKILVKLQKFGENLDLRIRPHVLLKVLQDLRIWELCSPDIAVAIEFVREHIIHMPQEDYISWLQSRINIPIGPYSALR

SEQ ID NO: 18626 - protein, 57 aa, Homo sapiens
  Payload ID: 3735
  Gene Symbol: CCDC60
  Gene Name: coiled-coil domain containing 60
  ENSP ID: ENSP00000443403
MTKVPATKKLQSSPNSGAVRPFYASENLRQVPDKPMKSIKYMDKEIINLKKDLIRSR

SEQ ID NO: 18627 - protein, 133 aa, Homo sapiens
  Payload ID: 3735
  Gene Symbol: CCDC60
  Gene Name: coiled-coil domain containing 60
  ENSP ID: ENSP00000445505
MTKVPATKKLQSSPNSGAVRPFYASENLRQVPDKPMKSIKYMDKEIINLKKDLIRSRLSHCRTQRRMGKRPNREATSKQERNDNEMFHLATLLDPTNIKEGIRIPLQKETPCFPREVISPSGTNSLTPYPSIK

SEQ ID NO: 18628 - protein, 332 aa, Homo sapiens
  Payload ID: 3736
  Gene Symbol: CCDC61
  Gene Name: coiled-coil domain containing 61
  Uniprot ID: Q9Y6R9
  ENSP ID: ENSP00000444279
MDQPAGLQVDYVFRGVEHAVRVMVSGQVLELEVEDRMTADQWRGEFDAGFIEDLTHKTGNFKQFNIFCHMLESALTQSSESVTLDLLTYTDLESLRNRKMGGRPGSLAPRSAQLNSKRYLILIYSVEFDRIHYPLPLPYQGKPDPVVLQGIIRSLKEELGRLQGLDGQNTRDTRENEIWHLREQQQQRNRLGSGGSGDGPSVSWSRQTQPPAALTGRGDAPNRSRNRSSSVDSFRSRCSSASSCSDLEDFSESLSRGGHRRRGKPPSPTPWSGSNMKSPPVERSHHQKSLANSGGWVPIKEYSSEHQAADMAEIDARLKALQEYMNRLDMRS

SEQ ID NO: 18629 - protein, 332 aa, Homo sapiens; identical to SEQ ID NO: 18628
  Payload ID: 3736
  Gene Symbol: CCDC61
  Gene Name: coiled-coil domain containing 61
  Uniprot ID: Q9Y6R9
  ENSP ID: ENSP00000469466

SEQ ID NO: 18630 - protein, 49 aa, Homo sapiens
  Payload ID: 3736
  Gene Symbol: CCDC61
  Gene Name: coiled-coil domain containing 61
  ENSP ID: ENSP00000469524
MDQPAGLQVDYVFRGVEHAVRVMVSGQVLELEVEDRMTADQWRGEFDAG

SEQ ID NO: 18631 - protein, 77 aa, Homo sapiens
  Payload ID: 3736
  Gene Symbol: CCDC61
  Gene Name: coiled-coil domain containing 61
  ENSP ID: ENSP00000469909
MDQPAGLQVDYVFRGVEHAVRVMVSGQVLELEVEDRMTADQWRGEFDAGFIEDLTHKTGNFKQFNIFCHMLESALTQ

SEQ ID NO: 18632 - protein, 512 aa, Homo sapiens
  Payload ID: 3736
  Gene Symbol: CCDC61
  Gene Name: coiled-coil domain containing 61
  Uniprot ID: Q9Y6R9
  ENSP ID: ENSP00000471454
MDQPAGLQVDYVFRGVEHAVRVMVSGQVLELEVEDRMTADQWRGEFDAGFIEDLTHKTGNFKQFNIFCHMLESALTQSSESVTLDLLTYTDLESLRNRKMGGRPGSLAPRSAQLNSKRYLILIYSVEFDRIHYPLPLPYQGKPDPVVLQGIIRSLKEELGRLQGLDGQNTRDTRENEIWHLREQVSRLASEKRELEAQLGRSREEALAGRAARQEAEALRGLVRGLELELRQERGLGHRVAGRRGQDCRRLAKELEEAKASERSLRARLKTLTSELALYKRGRRTPPVQPPPTREDRASSSRERSASRGRGAARSSSRESGRGSRGRGRPARPSPSPTGGRALRFDPTAFVKAKERKQREIQMKQQQRNRLGSGGSGDGPSVSWSRQTQPPAALTGRGDAPNRSRNRSSSVDSFRSRCSSASSCSDLEDFSESLSRGGHRRRGKPPSPTPWSGSNMKSPPVERSHHQKSLANSGGWVPIKEYSSEHQAADMAEIDARLKALQEYMNRLDMRS

SEQ ID NO: 18633 - protein, 684 aa, Homo sapiens
  Payload ID: 3737
  Gene Symbol: CCDC62
  Gene Name: coiled-coil domain containing 62
  Uniprot ID: Q6P9F0
  ENSP ID: ENSP00000253079
MNPPAAFLAGRQNIGSEVEISTIEKQRKELQLLIGELKDRDKELNDMVAVHQQQLLSWEEDRQKVLTLEERCSKLEGELHKRTEIIRSLTKKVKALESNQMECQTALQKTQLQLQEMAQKATHSSLLSEDLEARNETLSNTLVELSAQVGQLQAREQALTTMIKLKDKDIIEAVNHIADCSGKFKMLEHALRDAKMAETCIVKEKQDYKQKLKALKIEVNKLKEDLNEKTTENNEQREEIIRLKQEKSCLHDELLFTVEREKRKDELLNIAKSKQERTNSELHNLRQIYVKQQSDLQFLNFNVENSQELIQMYDSKMEESKALDSSRDMCLSDLENNHPKVDIKREKNQKSLFKDQKFEAMLVQQNRSDKSSCDECKEKKQQIDTVFGEKSVITLSSIFTKDLVEKHNLPWSLGGKTQIEPENKITLCKIHTKSPKCHGTGVQNEGKQPSETPTLSDEKQWHDVSVYLGLTNCPSSKHPEKLDVECQDQMERSEISCCQKNEACLGESGMCDSKCCHPSNFIIEAPGHMSDVEWMSIFKPSKMQRIVRLKSGCTCSESICGTQHDSPASELIAIQDSHSLGSSKSALREDETESSSNKKNSPTSLLIYKDAPAFNEKASIVLPSQDDFSPTSKLQRLLAESRQMVTDLELSTLLPISHENLTGSATNKSEVPEESAQKNTFVSY

SEQ ID NO: 18634 - protein, 682 aa, Homo sapiens
  Payload ID: 3737
  Gene Symbol: CCDC62
  Gene Name: coiled-coil domain containing 62
  Uniprot ID: Q6P9F0
  ENSP ID: ENSP00000341471
MNPPAAFLAGRQNIGSEVEISTIEKQRKELQLLIGELKDRDKELNDMVAVHQQQLLSWEEDRQKVLTLEERCSKLEGELHKRTEIIRSLTKKVKALESNQMECQTALQKTQLQLQEMAQKATHSSLLSEDLEARNETLSNTLVELSAQVGQLQAREQALTTMIKLKDKDIIEAVNHIADCSGKFKMLEHALRDAKMAETCIVKEKQDYKQKLKALKIEVNKLKEDLNEKTTENNEQREEIIRLKQEKSCLHDELLFTVEREKRKDELLNIAKSKQERTNSELHNLRQIYVKQQSDLQFLNFNVENSQELIQMYDSKMEESKALDSSRDMCLSDLENNHPKVDIKREKNQKSLFKDQKFEAMLVQQNRSDKSSCDECKEKKQQIDTVFGEKSVITLSSIFTKDLVEKHNLPWSLGGKTQIEPENKITLCKIHTKSPKCHGTGVQNEGKQPSETPTLSDEKQWHDVSVYLGLTNCPSSKHPEKLDVECQDQMERSEISCCQKNEACLGESGMCDSKCCHPSNFIIEAPGHMSDVEWMSIFKPSKMQRIVRLKSGCTCSESICGTQHDSPASELIAIQDSHSLGSSKSALREDETESSSNKKNSPTSLLIYKDAPAFNEKASIVLPSQDDFSPTSKLQRLLAESRQMVTDLELSTLLPISHENLTGSATNISHLCGRQKADTNTE

SEQ ID NO: 18635 - protein, 497 aa, Homo sapiens
  Payload ID: 3737
  Gene Symbol: CCDC62
  Gene Name: coiled-coil domain containing 62
  ENSP ID: ENSP00000376235
MLEHALRDAKMAETCIVKEKQDYKQKLKALKIEVNKLKEDLNEKTTENNEQREEIIRLKQEKSCLHDELLFTVEREKRKDELLNIAKSKQERTNSELHNLRQIYVKQQSDLQFLNFNVENSQELIQMYDSKMEESKALDSSRDMCLSDLENNHPKVDIKREKNQKSLFKDQKFEAMLVQQNRSDKSSCDECKEKKQQIDTVFGEKSVITLSSIFTKDLVEKHNLPWSLGGKTQIEPENKITLCKIHTKSPKCHGTGVQNEGKQPSETPTLSDEKQWHDVSVYLGLTNCPSSKHPEKLDVECQDQMERSEISCCQKNEACLGESGMCDSKCCHPSNFIIEAPGHMSDVEWMSIFKPSKMQRIVRLKSGCTCSESICGTQHDSPASELIAIQDSHSLGSSKSALREDETESSSNKKNSPTSLLIYKDAPAFNEKASIVLPSQDDFSPTSKLQRLLAESRQMVTDLELSTLLPISHENLTGSATNISHLCGRQKADTNTE

SEQ ID NO: 18636 - protein, 682 aa, Homo sapiens; identical to SEQ ID NO: 18634
  Payload ID: 3737
  Gene Symbol: CCDC62
  Gene Name: coiled-coil domain containing 62
  Uniprot ID: Q6P9F0
  ENSP ID: ENSP00000376236

SEQ ID NO: 18637 - protein, 64 aa, Homo sapiens
  Payload ID: 3737
  Gene Symbol: CCDC62
  Gene Name: coiled-coil domain containing 62
  ENSP ID: ENSP00000439893
MNPPAAFLAGRQARNETLSNTLVELSAQVGQLQAREQALTTMIKLKDKDIIEAVNHIADCSGKF

SEQ ID NO: 18638 - protein, 445 aa, Homo sapiens
  Payload ID: 3737
  Gene Symbol: CCDC62
  Gene Name: coiled-coil domain containing 62
  Uniprot ID: Q6P9F0
  ENSP ID: ENSP00000445045
MPNSSPKDPTTASGNGSKVEREKRKDELLNIAKSKQERTNSELHNLRQIYVKQQSDLQFLNFNVENSQELIQMYDSKMEESKALDSSRDMCLSDLENNHPKVDIKREKNQKSLFKDQKFEAMLVQQNRSDKSSCDECKEKKQQIDTVFGEKSVITLSSIFTKDLVEKHNLPWSLGGKTQIEPENKITLCKIHTKSPKCHGTGVQNEGKQPSETPTLSDEKQWHDVSVYLGLTNCPSSKHPEKLDVECQDQMERSEISCCQKNEACLGESGMCDSKCCHPSNFIIEAPGHMSDVEWMSIFKPSKMQRIVRLKSGCTCSESICGTQHDSPASELIAIQDSHSLGSSKSALREDETESSSNKKNSPTSLLIYKDAPAFNEKASIVLPSQDDFSPTSKLQRLLAESRQMVTDLELSTLLPISHENLTGSATNKSEVPEESAQKNTFVSY

SEQ ID NO: 18639 - protein, 563 aa, Homo sapiens
  Payload ID: 3738
  Gene Symbol: CCDC63
  Gene Name: coiled-coil domain containing 63
  Uniprot ID: Q8NA47
  ENSP ID: ENSP00000312399
MSVLKKNRRKDSDTPQEPSEKAKEQQAEAELRKLRQQFRKMVESRKSFKFRNQQKIASQYKEIKTLKTEQDEITLLLSLMKSSRNMNRSEKNYMELRLLLQTKEDYEALIKSLKVLLAELDEKILQMEKKIANQKQIFAKMQEANNPRKLQKQIHILETRLNLVTVHFDKMLTTNAKLRKEIEDLRFEKAAYDNVYQQLQHCLLMEKKTMNLAIEQSSQAYEQRVEAMARMAAMKDRQKKDTSQYNLEIRELERLYAHESKLKSFLLVKLNDRNEFEEQAKREEALKAKKHVKKNRGESFESYEVAHLRLLKLAESGNLNQLIEDFLAKEEKNFARFTYVTELNNDMEMMHKRTQRIQDEIILLRSQQKLSHDDNHSVLRQLEDKLRKTTEEADMYESKYGEVSKTLDLLKNSVEKLFKKINCDATKILVQLGETGKVTDINLPQYFAIIEKKTNDLLLLETYRRILEVEGAEAEIPPPFINPFWGGSALLKPPEPIKVIPPVLGADPFSDRLDDVEQPLDHSSLRQLVLDNYILKENRSKEVRGDSLPEKVDDFRSRKKVTM

SEQ ID NO: 18640 - protein, 523 aa, Homo sapiens
  Payload ID: 3738
  Gene Symbol: CCDC63
  Gene Name: coiled-coil domain containing 63
  Uniprot ID: Q8NA47
  ENSP ID: ENSP00000445881
MVESRKSFKFRNQQKIASQYKEIKTLKTEQDEITLLLSLMKSSRNMNRSEKNYMELRLLLQTKEDYEALIKSLKVLLAELDEKILQMEKKIANQKQIFAKMQEANNPRKLQKQIHILETRLNLVTVHFDKMLTTNAKLRKEIEDLRFEKAAYDNVYQQLQHCLLMEKKTMNLAIEQSSQAYEQRVEAMARMAAMKDRQKKDTSQYNLEIRELERLYAHESKLKSFLLVKLNDRNEFEEQAKREEALKAKKHVKKNRGESFESYEVAHLRLLKLAESGNLNQLIEDFLAKEEKNFARFTYVTELNNDMEMMHKRTQRIQDEIILLRSQQKLSHDDNHSVLRQLEDKLRKTTEEADMYESKYGEVSKTLDLLKNSVEKLFKKINCDATKILVQLGETGKVTDINLPQYFAIIEKKTNDLLLLETYRRILEVEGAEAEIPPPFINPFWGGSALLKPPEPIKVIPPVLGADPFSDRLDDVEQPLDHSSLRQLVLDNYILKENRSKEVRGDSLPEKVDDFRSRKKVTM

SEQ ID NO: 18641 - protein, 484 aa, Homo sapiens
  Payload ID: 3738
  Gene Symbol: CCDC63
  Gene Name: coiled-coil domain containing 63
  ENSP ID: ENSP00000450217
MKSSRNMNRSEKNYMELRLLLQTKEDYEALIKSLKVLLAELDEKILQMEKKIANQKQIFAKMQEANNPRKLQKQIHILETRLNLVTVHFDKMLTTNAKLRKEIEDLRFEKAAYDNVYQQLQHCLLMEKKTMNLAIEQSSQAYEQRVEAMARMAAMKDRQKKDTSQYNLEIRELERLYAHESKLKSFLLVKLNDRNEFEEQAKREEALKAKKHVKKNRGESFESYEVAHLRLLKLAESGNLNQLIEDFLAKEEKNFARFTYVTELNNDMEMMHKRTQRIQDEIILLRSQQKLSHDDNHSVLRQLEDKLRKTTEEADMYESKYGEVSKTLDLLKNSVEKLFKKINCDATKILVQLGETGKVTDINLPQYFAIIEKKTNDLLLLETYRRILEVEGAEAEIPPPFINPFWGGSALLKPPEPIKVIPPVLGADPFSDRLDDVEQPLDHSSLRQLVLDNYILKENRSKEVRGDSLPEKVDDFRSRKKVTM

SEQ ID NO: 18642 - protein, 573 aa, Homo sapiens
  Payload ID: 3739
  Gene Symbol: CCDC64
  Gene Name: coiled-coil domain containing 64
  Uniprot ID: Q6ZP65
  ENSP ID: ENSP00000380690
MSAFCLGLVGRASAPAEPDSACCMELPAAAGDAVRSPAAAAALIFPGGSGELELALEEELALLAAGERPSDPGEHPQAEPGSLAEGAGPQPPPSQDPELLSVIRQKEKDLVLAARLGKALLERNQDMSRQYEQMHKELTDKLEHLEQEKHELRRRFENREGEWEGRVSELESDVKQLQDELERQQIHLREADREKSRAVQELSEQNQRLLDQLSRASEVERQLSMQVHALREDFREKNSSTNQHIIRLESLQAEIKMLSDRKRELEHRLSATLEENDLLQGTVEELQDRVLILERQGHDKDLQLHQSQLELQEVRLSCRQLQVKVEELTEERSLQSSAATSTSLLSEIEQSMEAEELEQEREQLRLQLWEAYCQVRYLCSHLRGNDSADSAVSTDSSMDESSETSSAKDVPAGSLRTALNELKRLIQSIVDGMEPTVTLLSVEMTALKEERDRLRVTSEDKEPKEQLQKAIRDRDEAIAKKNAVELELAKCRMDMMSLNSQLLDAIQQKLNLSQQLEAWQDDMHRVIDRQLMDTHLKERSQPAAALCRGHSAGRGDEPSIAEGKRLFSFFRKI

SEQ ID NO: 18643 - protein, 291 aa, Homo sapiens
  Payload ID: 3739
  Gene Symbol: CCDC64
  Gene Name: coiled-coil domain containing 64
  ENSP ID: ENSP00000447477
ERSLQSSAATSTSLLSEIEQSMEAEELEQEREQLRLQLWEAYCQVRYLCSHLRGNDSADSAVSTDSSMDESSETSSAKDVPAGSLRTALNELKRLIQSIVDGMEPTGSRRLDDDSLEEQIRQTSEDSRALRELMEGERGKLRQSLEELQRLHSQVTLLSVEMTALKEERDRLRVTSEDKEPKEQLQKAIRDRDEAIAKKNAVELELAKCRMDMMSLNSQLLDAIQQKLNLSQQLEAWQDDMHRVIDRQLMDTHLKERSQPAAALCRGHSAGRGDEPSIAEGKRLFSFFRKI

SEQ ID NO: 18644 - protein, 77 aa, Homo sapiens
  Payload ID: 3739
  Gene Symbol: CCDC64
  Gene Name: coiled-coil domain containing 64
  ENSP ID: ENSP00000447939
  MOD_RES (1)..(1): Any amino acid
XKEPKEQLQKAIRDRDEAIAKKNAVELELAKCRMDMMSLNSQLLDAIQQKLNLSQQLEAWQFASSGLFTIWLLWFLI

SEQ ID NO: 18645 - protein, 228 aa, Homo sapiens
  Payload ID: 3739
  Gene Symbol: CCDC64
  Gene Name: coiled-coil domain containing 64
  ENSP ID: ENSP00000449064
  MOD_RES (1)..(1): Any amino acid
XCLGLVGRASAPAEPDSACCMELPAAAGDAVRSPAAAAALIFPGGSGELELALEEELALLAAGERPSDPGEHPQAEPGSLAEGAGPQPPPSQDPELLSVIRQKEKDLVLAARLGKALLERNQDMSRQYEQMHKELTDKLEHLEQEKHELRRRFENREGEWEGRVSELESDVKQLQDELERQQIHLREADREKSRAVQELSEQNQRLLDQLSRKIKTWIYYSTSALLVY

SEQ ID NO: 18646 - protein, 508 aa, Homo sapiens
  Payload ID: 3740
  Gene Symbol: CCDC64B
  Gene Name: coiled-coil domain containing 64B
  Uniprot ID: A1A5D9
  ENSP ID: ENSP00000373998
MSSPDGPSFPSGPLSGGASPSGDEGFFPFVLERRDSFLGGGPGPEEPEDLALQLQQKEKDLLLAAELGKMLLERNEELRRQLETLSAQHLEREERLQQENHELRRGLAARGAEWEARAVELEGDVEALRAQLGEQRSEQQDSGRERARALSELSEQNLRLSQQLAQASQTEQELQRELDALRGQCQAQALAGAELRTRLESLQGENQMLQSRRQDLEAQIRGLREEVEKGEGRLQTTHEELLLLRRERREHSLELERARSEAGEALSALRRLQRRVSELEEESRLQDADVSAASLQSELAHSLDDGDQGQGADAPGDTPTTRSPKTRKASSPQPSPPEEILEPPKKRTSLSPAEILEEKEVEVAKLQDEISLQQAELQSLREELQRQKELRAQEDPGEALHSALSDRDEAVNKALELSLQLNRVSLERDSLSRELLRAIRQKVALTQELEAWQDDMQVVIGQQLRSQRQKELSASASSSTPRRAAPRFSLRLGPGPAGGFLSNLFRRT

SEQ ID NO: 18647 - protein, 508 aa, Homo sapiens; identical to SEQ ID NO: 18646
  Payload ID: 3740
  Gene Symbol: CCDC64B
  Gene Name: coiled-coil domain containing 64B
  Uniprot ID: A1A5D9
  ENSP ID: ENSP00000459043

SEQ ID NO: 18648 - protein, 301 aa, Homo sapiens
  Payload ID: 3740
  Gene Symbol: CCDC64B
  Gene Name: coiled-coil domain containing 64B
  Uniprot ID: A1A5D9
  ENSP ID: ENSP00000461724
MLQSRRQDLEAQIRGLREEVEKGEGRLQTTHEELLLLRRERREHSLELERARSEAGEALSALRRLQRRVSELEEESRLQDADVSAASLQSELAHSLDDGDQGQGADAPGDTPTTRSPKTRKASSPQPSPPEEILEPPKKRTSLSPAEILEEKEVEVAKLQDEISLQQAELQSLREELQRQKELRAQEDPGEALHSALSDRDEAVNKALELSLQLNRVSLERDSLSRELLRAIRQKVALTQELEAWQDDMQVVIGQQLRSQRQKELSASASSSTPRRAAPRFSLRLGPGPAGGFLSNLFRRT

SEQ ID NO: 18649 - protein, 497 aa, Homo sapiens
  Payload ID: 3741
  Gene Symbol: CCDC65
  Gene Name: coiled-coil domain containing 65
  Uniprot ID: Q8IXS2
  ENSP ID: ENSP00000266984
MPKKEKMAKTPLSDEKQLLLFQQKLLAEEEMAKKKERLLSQFLKDKLAKEEHNSALNLNKINTQWRTVLREVKTRELHKDIEILSQTFERVVDCKDNVIKSLAKDLSEAEEQYAHALRSHLHNVDQLLALQRHRLSLLEESYNMELEALTKEFETERKTIIDQHEKEIHYLQDIFMAMEQNYIDSEYESKLEFQSMWNDLKNMNLEEKHFLRLHLENRVEDLWRKFQDVLKNYTDATEDRKAAFETLQVKDEKSSKEIEVQMKKIQKLQDAITISKGKIMIHSRESEDENRYIRNDKELVLVQLRKLKAQRTQARAASQKNLVRLTLESNATLKALRKIVDKGEKILKLAEICRKFETEEEKVLPFYSSVLTPKEQEGIQKNNLEELTEELTKVMVDYIGMENFWKRYNKVKLEQLSLQHRRAQLLDINGKLREMLKQYLDGISVSDEVLSQLNPLFIVNYQSNLLQPLSIRIAHPGSTSPSAPWRDQRRSFFLGSS

SEQ ID NO: 18650 - protein, 484 aa, Homo sapiens
  Payload ID: 3741
  Gene Symbol: CCDC65
  Gene Name: coiled-coil domain containing 65
  Uniprot ID: Q8IXS2
  ENSP ID: ENSP00000312706
MPKKEKMAKTPLSDEKQLLLFQQKLLAEEEMAKKKERLLSQFLKDKLAKEEHNSALNLNKINTQWRTVLREVKTRELHKDIEILSQTFERVVDCKDNVIKSLAKDLSEAEEQYAHALRSHLHNVDQLLALQRHRLSLLEESYNMELEALTKEFETERKTIIDQHEKEIHYLQDIFMAMEQNYIDSEYESKLEFQSMWNDLKNMNLEEKHFLRLHLENRVEDLWRKFQDVLKNYTDATEDRKAAFETLQVKDEKSSKEIEVQMKKIQKLQDAITISKGKIMIHSRESEDENRYIRNDKELVLVQLRKLKAQRTQARAASQKNLVRLTLESNATLKALRKIVDKGEKILKLAEICRKFETEEEKVLPFYSSVLTPKEQEGIQKNNLEELTEELTKVMVDYIGMENFWKRYNKVKLEQLSLQHRRAQLLDINGKLREMLKQYLDGISVSDEVLSQLNPLFIVNYQSNLLQPLSIRIAHPGDKQHPTT

SEQ ID NO: 18651 - protein, 373 aa, Homo sapiens
  Payload ID: 3741
  Gene Symbol: CCDC65
  Gene Name: coiled-coil domain containing 65
  ENSP ID: ENSP00000446569
MPKKEKMAKTPLSDEKQLLLFQQKLLAEEEMAKKKERLLSQFLKDKLAKEEHNSALNLNKINTQWRTVLREVKTRELHKDIEILSQTFERVVDCKDNVIKNLEEKHFLRLHLENRVEDLWRKFQDVLKNYTDATEDRKAAFETLQVKDEKSSKEIEVQMKKIQKLQDAITISKGKIMIHSRESEDENRYIRNDKELVLVQLRKLKAQRTQARAASQKNLVRLTLESNATLKALRKIVDKGEKILKLAEICRKFETEEEKVLPFYSSVLTPKEQEGIQKNNLEELTEELTKVMVDYIGMENFWKRYNKVKLEQLSLQHRRAQLLDINGKLREMLKQYLDGISVSDEVLSQLNPLFIVNYQSNLLQPLSIRIAHP

SEQ ID NO: 18652 - protein, 42 aa, Homo sapiens
  Payload ID: 3741
  Gene Symbol: CCDC65
  Gene Name: coiled-coil domain containing 65
  ENSP ID: ENSP00000447157
MPKKEKMAKTPLSDEKQLLLFQQKLLAEEEMAKKKERNTTVL

SEQ ID NO: 18653 - protein, 914 aa, Homo sapiens
  Payload ID: 3742
  Gene Symbol: CCDC66
  Gene Name: coiled-coil domain containing 66
  Uniprot ID: A2RUB6
  ENSP ID: ENSP00000326050
MGNKAKIAKCPLRTKTGHILKSTQDTCIGSEKLLQKKPVGSETSQAKGEKNGMTFSSTKDLCKQCIDKDCLHIQKEISPATPNMQKTRNTVNTSLVGKQKPHKKHITAENMKSSLVCLTQDQLQQILMTVNQGNRSLSLTENGKEAKSQYSLYLNSISNQPKDENIMGLFKKTEMVSSVPAENKSVLNEHQETSKQCEQKIAIENEWKPADIFSTLGERECDRSSLEAKKAQWRKELDEQVALKKKEKEVSEKWNDPWKKSESDKIIWEKHQILDQSRETVLLEHPFSAVKQELQRKWIEELNKQIEDDRQRKIEEKIIYSKGEEHDRWAMHFDSLKSYPGSQSQLFSQSTHKQPEYFCVSPDTQELADVSSVCTPTTGSQVEPSEEEHIAKPIKDVVMANSKKTNFLRSMTALLDPAQIEERDRRRQKQLEHQKAITAQVEEKRRKKQLEEEQRKKEEQEEELRLAQEREEMQKQYEEDILKQKQKEEIMTLKTNELFQTMQRAQELAQRLKQEQRIRELAQKGHDTSRLIKNLGVDTIQMEYNASNISNSRHDSDEISGKMNTYMNSTTSKKDTGVQTDDLNIGIFTNAESHCGSLMERDITNCSSPEISAELIGQFSTKKNKQELTQDKGASLEKENNRCNDQCNQFTRIEKQTKHMKKYPKRPDWNINKPPKRYIPASEKYPKQLQKQREEKKVRRQMELLHLVEKNNPGHLSQNRGISPEIFHSSHQETESKLRWHLVKKEEEPLNIHSFSKERSPSSPVPVVKNRTQQTQNTLHLPLKNSSYERENLISGSNQTELSSGISESSHFIPYVRTNEIYYLDPDAPLSGPSTQDPQYQNSQDCGQKRQLFDSDCVRDPLLNPNMVKNRDRQQAILKGLSELRQGLLQKQKELESSLLPLAENQEESFGSSF

SEQ ID NO: 18654 - protein, 230 aa, Homo sapiens
  Payload ID: 3742
  Gene Symbol: CCDC66
  Gene Name: coiled-coil domain containing 66
  ENSP ID: ENSP00000343840
MNLGDGLKLETELLDGKTKLILSPYEHKSKISVKMGNKAKIAKCPLRTKTGHILKSTQDTCIGSEKLLQKKPVGSETSQAKGEKNGMTFSSTKDLCKQCIDKDCLHIQKEISPATPNMQKTRNTVNTSLVGKQKPHKKHITAENMKSSLVCLTQDQLQQILMTVNQGNRSLSLTENGKEAKSQYSLYLNSISNQPKDENIMGLFKKTEMVSSVPAENKSVLNEHQETSKQ

SEQ ID NO: 18655 - protein, 948 aa, Homo sapiens
  Payload ID: 3742
  Gene Symbol: CCDC66
  Gene Name: coiled-coil domain containing 66
  Uniprot ID: A2RUB6
  ENSP ID: ENSP00000378167
MNLGDGLKLETELLDGKTKLILSPYEHKSKISVKMGNKAKIAKCPLRTKTGHILKSTQDTCIGSEKLLQKKPVGSETSQAKGEKNGMTFSSTKDLCKQCIDKDCLHIQKEISPATPNMQKTRNTVNTSLVGKQKPHKKHITAENMKSSLVCLTQDQLQQILMTVNQGNRSLSLTENGKEAKSQYSLYLNSISNQPKDENIMGLFKKTEMVSSVPAENKSVLNEHQETSKQCEQKIAIENEWKPADIFSTLGERECDRSSLEAKKAQWRKELDEQVALKKKEKEVSEKWNDPWKKSESDKIIWEKHQILDQSRETVLLEHPFSAVKQELQRKWIEELNKQIEDDRQRKIEEKIIYSKGEEHDRWAMHFDSLKSYPGSQSQLFSQSTHKQPEYFCVSPDTQELADVSSVCTPTTGSQVEPSEEEHIAKPIKDVVMANSKKTNFLRSMTALLDPAQIEERDRRRQKQLEHQKAITAQVEEKRRKKQLEEEQRKKEEQEEELRLAQEREEMQKQYEEDILKQKQKEEIMTLKTNELFQTMQRAQELAQRLKQEQRIRELAQKGHDTSRLIKNLGVDTIQMEYNASNISNSRHDSDEISGKMNTYMNSTTSKKDTGVQTDDLNIGIFTNAESHCGSLMERDITNCSSPEISAELIGQFSTKKNKQELTQDKGASLEKENNRCNDQCNQFTRIEKQTKHMKKYPKRPDWNINKPPKRYIPASEKYPKQLQKQREEKKVRRQMELLHLVEKNNPGHLSQNRGISPEIFHSSHQETESKLRWHLVKKEEEPLNIHSFSKERSPSSPVPVVKNRTQQTQNTLHLPLKNSSYERENLISGSNQTELSSGISESSHFIPYVRTNEIYYLDPDAPLSGPSTQDPQYQNSQDCGQKRQLFDSDCVRDPLLNPNMVKNRDRQQAILKGLSELRQGLLQKQKELESSLLPLAENQEESFGSSF

SEQ ID NO: 18656 - protein, 60 aa, Homo sapiens
  Payload ID: 3742
  Gene Symbol: CCDC66
  Gene Name: coiled-coil domain containing 66
  ENSP ID: ENSP00000390652
MNLGDGLKLETELLDGKTKLILSPYEHKSKISVKCLKVFACLWIEPSLDDVPLYPSTLSP

SEQ ID NO: 18657 - protein, 60 aa, Homo sapiens; identical to SEQ ID NO: 18656
  Payload ID: 3742
  Gene Symbol: CCDC66
  Gene Name: coiled-coil domain containing 66
  ENSP ID: ENSP00000394704

SEQ ID NO: 18658 - protein, 633 aa, Homo sapiens
  Payload ID: 3742
  Gene Symbol: CCDC66
  Gene Name: coiled-coil domain containing 66
  ENSP ID: ENSP00000401451
MNLGDGLKLETELLDGKTKLILSPYEHKSKISVKMGNKAKIAKCPLRTKTGHILKSTQDTCIGSEKLLQKKPVGSETSQAKGEKNGMTFSSTKDLCKQCIDKDCLHIQKEISPATPNMQKTRNTVNTSLVGKQKPHKKHITAENMKSSLVCLTQDQLQQILMTVNQGNRSLSLTENGKEAKSQYSLYLNSISNQPKDENIMGLFKKTEMVSSVPAENKSVLNEHQETSKQCEQKIAIENEWKPADIFSTLGERECDRSSLEAKKAQWRKELDEQVALKKKEKEVSEKWNDPWKKSESDKIIWEKHQILDQSRGEEHDRWAMHFDSLKSYPGSQSQLFSQSTHKQPEYFCVSPDTQELADVSSVCTPTTGSQVEPSEEEHIAKPIKDVVMANSKKTNFLRSMTALLDPAQIEERDRRRQKQLEHQKAITAQVEEKRRKKQLEEEQRKKEEQEEELRLAQEREEMQKQYEEDILKQKQKEEIMTLKTNELFQTMQRAQELAQRLKQEQRIRELAQKGHDTSRLIKNLGVDTIQMEYNASNISNSRHDSDEISGKMNTYMNSTTSKKDTGVQTDDLNIGIFTNAESHCGSLMERDITNCSSPEISAELIGQFSTKKNKQELTQDKGASLEKENNRC

SEQ ID NO: 18659 - protein, 38 aa, Homo sapiens
  Payload ID: 3742
  Gene Symbol: CCDC66
  Gene Name: coiled-coil domain containing 66
  ENSP ID: ENSP00000410510
MNLGDGLKLETELLDGKTKLILSPYEHKSKISVKADLL

SEQ ID NO: 18660 - protein, 287 aa, Homo sapiens
  Payload ID: 3742
  Gene Symbol: CCDC66
  Gene Name: coiled-coil domain containing 66
  ENSP ID: ENSP00000420192
MGNKAKIAKCPLRTKTGHILKSTQDTCIGSEKLLQKKPVGSETSQAKGEKNGMTFSSTKDLCKQCIDKDCLHIQKEISPATPNMQKTRNTVNTSLVGKQKPHKKHITAENMKSSLVCLTQDQLQQILMTVNQGNRSLSLTENGKEAKSQYSLYLNSISNQPKDENIMGLFKKTEMVSSVPAENKSVLNEHQETSKQCEQKIAIENEWKPADIFSTLGERECDRSSLEAKKAQWRKELDEQVALKKKEKEVSEKWNDPWKKSESDKIIWEKHQILDQSRLFKHSITVS

SEQ ID NO: 18661 - protein, 604 aa, Homo sapiens
  Payload ID: 3743
  Gene Symbol: CCDC67
  Gene Name: coiled-coil domain containing 67
  Uniprot ID: Q05D60
  ENSP ID: ENSP00000298050
MENQAHNTMGTSPCEAELQELMEQIDIMVSNKKMDWERKMRALETRLDLRDQELANAQTCLDQKGQEVGLLRQKLDSLEKCNLAMTQNYEGQLQSLKAQFSKLTNNFEKLRLHQMKQNKVPRKELPHLKEEIPFELSNLNQKLEEFRAKSREWDKQEILYQTHLISLDAQQKLLSEKCNQFQKQAQSYQTQLNGKKQCLEDSSSEIPRLICDPDPNCEINERDEFIIEKLKSAVNEIALSRNKLQDENQKLLQELKMYQRQCQAMEAGLSEVKSELQSRDDLLRIIEMERLQLHRELLKIGECQNAQGNKTRLESSYLPSIKEPERKIKELFSVMQDQPNHEKELNKIRSQLQQVEEYHNSEQERMRNEISDLTEELHQKEITIATVTKKAALLEKQLKMELEIKEKMLAKQKVSDMKYKAVRTENTHLKGMMGDLDPGEYMSMDFTNREQSRHTSINKLQYENERLRNDLAKLHVNGKSTWTNQNTYEETGRYAYQSQIKVEQNEERLSHDCEPNRSTMPPLPPSTFQAKEMTSPLVSDDDVFPLSPPDMSFPASLAAQHFLLEEEKRAKELEKLLNTHIDELQRHTEFTLNKYSKLKQNRHI

SEQ ID NO: 18662 - protein, 553 aa, Homo sapiens
  Payload ID: 3743
  Gene Symbol: CCDC67
  Gene Name: coiled-coil domain containing 67
  ENSP ID: ENSP00000431946
MEQIDIMVSNKKMDWERKMRALETRLDLRDQELANAQTCLDQKGQEVGLLRQKLDSLEKCNLAMTQNYEGQLQSLKAQFSKLTNNFEKLRLHQMKQNKVPRKELPHLKEEIPFELSNLNQKLEEFRAKSREWDKQEILYQTHLISLDAQQKLLSEKCNQFQKQAQSYQTQLNGKKQCLEDSSSEIPRLICDPDPNCEINERDEFIIEKLKSAVNEIALSRNKLQDENQKLLQELKMYQRQCQAMEAGLSEVKSELQSRDDLLRIIEMERLQLHRELLKIGECQNAQGNKTRLESSYLPSIKEPERKIKELFSVMQDQPNHEKELNKIRSQLQQVEEYHNSEQERMRNEISDLTEELHQKEITIATVTKKAALLEKQLKMELEIKEKMLAKQKVSDMKYKAVRTENTHLKGMMGDLDPGEYMSMDFTNREQSRHTSINKLQYENERLRNDLAKLHVNGKSTWTNQNTYEETGRYAYQSQIKVEQNEERLSHDCEPNRSTMPPLPPSTFQAKEMTSPLVSDDDVFPLVSCWLWAFFFFNGLLLYSYTDVNKLTYI

SEQ ID NO: 18663 - protein, 348 aa, Homo sapiens
  Payload ID: 3743
  Gene Symbol: CCDC67
  Gene Name: coiled-coil domain containing 67
  ENSP ID: ENSP00000432111
MENQAHNTMGTSPCEAELQELMEQIDIMVSNKKMDWERKMRALETRLDLRDQELANAQTCLDQKGQEVGLLRQKLDSLEKCNLAMTQNYEGQLQSLKAQFSKLTNNFEKLRLHQMKQNKVPRKELPHLKEEIPFELSNLNQKLEEFRAKSREWDKQEILYQTHLISLDAQQKLLSEKCNQFQKQAQSYQTQLNGKKQCLEDSSSEIPRLICDPDPNCEINERDEFIIEKLKSAVNEIALSRNKLQDENQKLLQELKMYQRQCQAMEAGLSEVKSELQSRDDLLRIIEMERLQLHRELLKIGECQNAQGNKTRLESSYLPSIKEPERKIKELFSVMQDQPNHEKELNKR

SEQ ID NO: 18664 - protein, 106 aa, Homo sapiens
  Payload ID: 3743
  Gene Symbol: CCDC67
  Gene Name: coiled-coil domain containing 67
  ENSP ID: ENSP00000433002
MENQAHNTMGTSPCEAELQELMEQIDIMVSNKKMDWERKMRALETRLDLRDQELANAQTCLDQKGQEVGLLRQKLDSLEKCNLAMTQNYEGQLQSLKAQVRKLIII

SEQ ID NO: 18665 - protein, 53 aa, Homo sapiens
  Payload ID: 3743
  Gene Symbol: CCDC67
  Gene Name: coiled-coil domain containing 67
  ENSP ID: ENSP00000433254
MENQAHNTMGLKCKTSITTCLSSLSDWTYTSSLENASASLKKNSVVRALTNLS

SEQ ID NO: 18666 - protein, 445 aa, Homo sapiens
  Payload ID: 3743
  Gene Symbol: CCDC67
  Gene Name: coiled-coil domain containing 67
  ENSP ID: ENSP00000433537
MENQAHNTMGTSPCEAELQELMEQIDIMVSNKKMDWERKMRALETRLDLRDQELANAQTCLDQKGQEVGLLRQKLDSLEKCNLAMTQNYEGQLQSLKAQFSKLTNNFEKLRLHQMKQNKVPRKELPHLKEEIPFELSNLNQKLEEFRAKSREWDKQEILYQTHLISLDAQQKLLSEKCNQFQKQAQSYQTQLNGKKQCLEDSSSEIPRLICDPDPNCEINERDEFIIEKLKSAVNEIALSRNKLQDENQKLLQELKMYQRQCQAMEAGLSEVKSELQSRDDLLRIIEMERLQLHRELLKIGECQNAQGNKTRLESSYLPSIKEPERKIKELFSVMQDQPNHEKELNKIRSQLQQVEEYHNSEQERMRNEISDLTEELHQKEITIATVTKKAALLEKQLKMELEIKEKMLAKQKVSDMKYKAVRTENTHLKGMMGDLDPGEYMVIC

SEQ ID NO: 18667 - protein, 329 aa, Homo sapiens
  Payload ID: 3743
  Gene Symbol: CCDC67
  Gene Name: coiled-coil domain containing 67
  ENSP ID: ENSP00000434635
MENQAHNTMGTSPCEAELQELMEQIDIMVSNKKMDWERKMRALETRLDLRDQELANAQTCLDQKGQEVGLLRQKLDSLEKCNLAMTQNYEGQLQSLKAQFSKLTNNFEKLRLHQMKQNKVPRKELPHLKEEIPFELSNLNQKLEEFRAKSREWDKQEILYQTHLISLDAQQKLLSEKCNQFQKQAQSYQTQLNGKKQCLEDSSSEIPRLICDPDPNCEINERDEFIIEKLKSAVNEIALSRNKLQDENQKLLQELKMYQRQCQAMEAGLSEVKSELQSRDDLLRIIEMERLQLHRELLKIGECQNAQGNKTRLESSYLPSIKEPERKIK

SEQ ID NO: 18668 - protein, 346 aa, Homo sapiens
  Payload ID: 3743
  Gene Symbol: CCDC67
  Gene Name: coiled-coil domain containing 67
  ENSP ID: ENSP00000435079
MGEFMAMEAGLSEVKSELQSRDDLLRIIEMERLQLHRELLKIGECQNAQGNKTRLESSYLPSIKEPERKIKELFSVMQDQPNHEKELNKIRSQLQQVEEYHNSEQERMRNEISDLTEELHQKEITIATVTKKAALLEKQLKMELEIKEKMLAKQKVSDMKYKAVRTENTHLKGMMGDLDPGEYMSMDFTNREQSRHTSINKLQYENERLRNDLAKLHVNGKSTWTNQNTYEETGRYAYQSQIKVEQNEERLSHDCEPNRSTMPPLPPSTFQAKEMTSPLVSDDDVFPLSPPDMSFPASLAAQHFLLEEEKRAKELEKLLNTHIDELQRHTEFTLNKYSKLKQNRHI

SEQ ID NO: 18669 - protein, 502 aa, Homo sapiens
  Payload ID: 3743
  Gene Symbol: CCDC67
  Gene Name: coiled-coil domain containing 67
  ENSP ID: ENSP00000435527
MENQAHNTMGTSPCEAELQELMEQIDIMVSNKKMDWERKMRALETRLDLRDQELANAQTCLDQKGQEVGLLRQKLDSLEKCNLAMTQNYEGQLQSLKAQFSKLTNNFEKLRLHQMKQNKVPRKELPHLKEEIPFELSNLNQKLEEFRAKSREWDKQEILYQTHLISLDAQQKLLSEKCNQFQKQAQSYQTQLNGKKQCLEDSSSEIPRLICDPDPNCEINERDEFIIEKLKSAVNEIALSRNKLQDENQKLLQELKMYQRQCQAMEAGLSEVKSELQSRDDLLRIIEMERLQLHRELLKIGECQNAQGNKTRLESSYLPSIKEPERKIKELFSVMQDQPNHEKELNKIRSQLQQVEEYHNSEQERMRNEISDLTEELHQKEITIATVTKKAALLEKQLKMELEIKEKMLAKQKVSDMKYKAVRTENTHLKGMMGDLDPGEYMSMDFTNREQSRHTSINKLQYENERLRNDLAKLHVNGKSTWTNQNTYEETGRYAYQSQIKT

SEQ ID NO: 18670 - protein, 599 aa, Homo sapiens
  Payload ID: 3743
  Gene Symbol: CCDC67
  Gene Name: coiled-coil domain containing 67
  ENSP ID: ENSP00000479457
MENQAHNTMGTSPCEAELQELMEQIDIMVSNKKMDWERKMRALETRLDLRDQELANAQTCLDQKGQEVGLLRQKLDSLEKCNLAMTQNYEGQLQSLKAQFSKLTNNFEKLRLHQMKQNKVPRKELPHLKEEIPFELSNLNQKLEEFRAKSREWDKQEILYQTHLISLDAQQKLLSEKCNQFQKQAQSYQTQLNGKKQCLEDSSSEIPRLICDPDPNCEINERDEFIIEKLKSAVNEIALSRNKLQDENQKLLQELKMYQRQCQAMEAGLSEVKSELQSRDDLLRIIEMERLQLHRELLKIGECQNAQGNKTRLESSYLPSIKEPERKIKELFSVMQDQPNHEKELNKIRSQLQQVEEYHNSEQERMRNEISDLTEELHQKEITIATVTKKAALLEKQLKMELEIKEKMLAKQKVSDMKYKAVRTENTHLKGMMGDLDPGEYMSMDFTNREQSRHTSINKLQYENERLRNDLAKLHVNGKSTWTNQNTYEETGRYAYQSQIKVEQNEERLSHDCEPNRSTMPPLPPSTFQAKEMTSPLVSDDDVFPLSPPDMSFPASLAAQHFLLEEEKRAKELEKLLNTHIDELQRHTEFTLNKYSKLK

SEQ ID NO: 18671 - protein, 335 aa, Homo sapiens
  Payload ID: 3744
  Gene Symbol: CCDC68
  Gene Name: coiled-coil domain containing 68
  Uniprot ID: Q9H2F9
  ENSP ID: ENSP00000337209
MTTVTVTTEIPPRDKMEDNSALYESTSAHIIEETEYVKKIRTTLQKIRTQMFKDEIRHDSTNHKLDAKHCGNLQQGSDSEMDPSCCSLDLLMKKIKGKDLQLLEMNKENEVLKIKLQASREAGAAALRNVAQRLFENYQTQSEEVRKKQEDSKQLLQVNKLEKEQKLKQHVENLNQVAEKLEEKHSQITELENLVQRMEKEKRTLLERKLSLENKLLQLKSSATYGKSCQDLQREISILQEQISHLQFVIHSQHQNLRSVIQEMEGLKNNLKEQDKRIENLREKVNILEAQNKELKTQVALSSETPRTKVSKAVSTSELKTEGVSPYLMLIRLRK

SEQ ID NO: 18672 - protein, 335 aa, Homo sapiens; identical to SEQ ID NO: 18671
  Payload ID: 3744
  Gene Symbol: CCDC68
  Gene Name: coiled-coil domain containing 68
  Uniprot ID: Q9H2F9
  ENSP ID: ENSP00000413406

SEQ ID NO: 18673 - protein, 335 aa, Homo sapiens; identical to SEQ ID NO: 18671
  Payload ID: 3744
  Gene Symbol: CCDC68
  Gene Name: coiled-coil domain containing 68
  Uniprot ID: Q9H2F9
  ENSP ID: ENSP00000466690

SEQ ID NO: 18674 - protein, 203 aa, Homo sapiens
  Payload ID: 3744
  Gene Symbol: CCDC68
  Gene Name: coiled-coil domain containing 68
  ENSP ID: ENSP00000466731
  MOD_RES (1)..(1): Any amino acid
XLFENYQTQSEEVRKKQEDSKQLLQVNKLEKEQKLKQHVENLNQVAEKLEEKHSQITELENLVQRMEKEKRTLLERKLSLENKLLQLKSSATYGKSCQDLQREISILQEQISHLQFVIHSQHQNLRSVIQEMEGLKNNLKEQDKRIENLREKVNILEAQNKELKTQVALSSETPRTKVSKAVSTSELKTEGVSPYLMLIRLRK

SEQ ID NO: 18675 - protein, 296 aa, Homo sapiens
  Payload ID: 3745
  Gene Symbol: CCDC69
  Gene Name: coiled-coil domain containing 69
  Uniprot ID: A6NI79
  ENSP ID: ENSP00000347586
MGCRHSRLSSCKPPKKKRQEPEPEQPPRPEPHELGPLNGDTAITVQLCASEEAERHQKDITRILQQHEEEKKKWAQQVEKERELELRDRLDEQQRVLEGKNEEALQVLRASYEQEKEALTHSFREASSTQQETIDRLTSQLEAFQAKMKRVEESILSRNYKKHIQDYGSPSQFWEQELESLHFVIEMKNERIHELDRRLILMETVKEKNLILEEKITTLQQENEDLHVRSRNQVVLSRQLSEDLLLTREALEKEVQLRRQLQQEKEELLYRVLGANASPAFPLAPVTPTEVSFLAT

SEQ ID NO: 18676 - protein, 88 aa, Homo sapiens
  Payload ID: 3745
  Gene Symbol: CCDC69
  Gene Name: coiled-coil domain containing 69
  ENSP ID: ENSP00000428588
KRQEPEPEQPPRPEPHELGPLNGDTAITVQLCASEEAERHQKDITRILQQHEEEKKKWAQQSSGPHMNRRKKRLPTLSGRPVLPSRRP

SEQ ID NO: 18677 - protein, 47 aa, Homo sapiens
  Payload ID: 3745
  Gene Symbol: CCDC69
  Gene Name: coiled-coil domain containing 69
  ENSP ID: ENSP00000430436
MGCRHSRLSSCKPPKKAIPPSLLQPPLHCLLKNRGWCGGLQVLTQAS

SEQ ID NO: 18678 - protein, 186 aa, Homo sapiens
  Payload ID: 3745
  Gene Symbol: CCDC69
  Gene Name: coiled-coil domain containing 69
  ENSP ID: ENSP00000430549
  MOD_RES (1)..(1): Any amino acid
XKRQEPEPEQPPRPEPHELGPLNGDTAITVQLCASEEAERHQKDITRILQQHEEEKKKWAQQVEKERELELRDRLDEQQRVLEGKNEEALQVLRASYEQEKEALTHSFREASSTQQETIDRLTSQLEAFQAKMKRVEESILSRNYKKHIQDYGSPSQFWEQELESLHFVIEMKNERIHELDRKRKI

SEQ ID NO: 18679 - protein, 486 aa, Homo sapiens
  Payload ID: 3746
  Gene Symbol: CCDC7
  Gene Name: coiled-coil domain containing 7
  Uniprot ID: Q96M83
  ENSP ID: ENSP00000277657
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNILESLFKWFQWQVNQMEEISKDQTLLQAEPPKPDKTVILNIAEIVRLVQRFEELKNRLKQRSKSSVKVMLSKTMDKENRPEAVKSCEALAQKIEEFLEAHSTDEFKDVSATEPQTAHSMTNRFNAMLKVFENQANMLERAVNDQVLLDAEYKQMQCDFQLLSEEKLVLENELQKLKDKEKTKPTNNRTKKAVKTVKKKDKGKSEDSEKKMSPEKEFKIKEDLDQVQKVARLEIENKVLQEQLKQALQEAEKAKHQLNYFLNQEKLLKSEGKTETTMQVGNSQTKVKGEDSKNIPLEKETRKSLVSDSGGQRTSDKIQEYPQITAQSGRLIEKRC

SEQ ID NO: 18680 - protein, 647 aa, Homo sapiens
  Payload ID: 3746
  Gene Symbol: CCDC7
  Gene Name: coiled-coil domain containing 7
  ENSP ID: ENSP00000303710
  MOD_RES (1)..(1): Any amino acid
XLSKTKLQIKKQETSTEQPLTTPDKEPNENLILRHQDSMSKSEMQVKEQRTLKGQRIITHDEEPGKNLVLEHQDSVSKLEMQIEKTKKLPREKRHSTHDEESGENPMLKHQDSVSKIQVQLEIQETSEGEGRSIPDKNSMFVHQDSVSKLQMQEKKKITPGRERRNNSKSKLQMQEKKQINSGVERHKTFPLEIKKKDISLEHLLPEEKVLLSRSESQTKKLQAKVTSRKIKNEAASELPDTAENLPAMYPSISDLIIQFDLNKVVETDIESLRGALGRRLLNDEFKTQSKSFPGPDIEQLTDAFGRDILKDEFKTRSKSLPETDERLHSTTERGTINDAIKTQLKRKSYPETVLKHLKGVNGKDIIKHLINIQSKSHGETDKEHLADDTGRGIIKGSINAQLKGHQKTDKNFFAYATGRGLMKESTTTQLKSHPETDKEFLADAIGRGIIIGPITTQLKSHRETDKELLKDAIGRDIIKGPISAQLKSHQETDVEPLTNAIGSSKTIGEIKTQLRTHYDVNLFKNKDMSVQRQEGIFTRSITPSKFPTKVINLSPFENKEETYEYSSPYVTAPSKAIYRTYRAGPSFSKDIHLPLLNQLPSGHSKVVTLSQKTIEFTLPTVTNTVGKPTYKVLHAAARKSVPHPYF

SEQ ID NO: 18681 - protein, 486 aa, Homo sapiens; identical to SEQ ID NO: 18679
  Payload ID: 3746
  Gene Symbol: CCDC7
  Gene Name: coiled-coil domain containing 7
  Uniprot ID: Q96M83
  ENSP ID: ENSP00000355078

SEQ ID NO: 18682 - protein, 628 aa, Homo sapiens
  Payload ID: 3746
  Gene Symbol: CCDC7
  Gene Name: coiled-coil domain containing 7
  Uniprot ID: Q9H943
  ENSP ID: ENSP00000364165
MTEEQTYQAAEKSQAHNEVPNERLVVEHQESLSKTKLQIKKQETSTEQPLTTPDKEPNENLILRHQDSMSKSEMQVKEQRTLKGQRIITHDEEPGKNLVLEHQDSVSKLEMQIEKTKKLPREKRHSTHDEESGENPMLKHQDSVSKIQVQLEIQETSEGEGRSIPDKNSMFVHQDSVSKLQMQEKKKITPGRERRNTRIVVPNENVISVHQDSKSKLQMQEKKQINSGVERHKTFPLEIKKKDISLEHLLPEEKVLLSRSESQTKKLQAKVTSRKKTDIESLRGALGRRLLNDEFKTQSKSFPGPDIEQLTDAFGRDILKDEFKTRSKSLPETDERLHSTTERGTINDAIKTQLKRKSYPETVLKHLKGVNGKDIIKHLINIQSKSHGETDKNFFAYATGRGLMKESTTTQLKSHPETDKEFLADAIGRGIIIGPITTQLKSHRETDKELLKDAIGRDIIKGPISAQLKSHQETDVEPLTNAIGSSKTIGEIKTQLRTHYDVNLFKNKDMSVQRQEGIFTRSITPSKFPTKVINLSPFENKEETYEYSSPYVTAPSKAIYRTYRAGPSFSKDIHLPLLNQLPSGHSKVVTLSQKTIEFTLPTVTNTVGKPTYKVLHAAARKSVPHPYF

SEQ ID NO: 18683 - protein, 632 aa, Homo sapiens
  Payload ID: 3746
  Gene Symbol: CCDC7
  Gene Name: coiled-coil domain containing 7
  ENSP ID: ENSP00000364168
MVPASASGEGLRELLLVQEGEVGADMSHAHNEVPNERLVVEHQESLSKTKLQIKKQETSTEQPLTTPDKEPNENLILRHQDSMSKSEMQVKEQRTLKGQRIITHDEESGENPMLKHQDSVSKIQVQLEIQETSEGEGRSIPDKNSMFVHQDSVSKLQMQEKKKITPGRERRNTRIVVPNENVISVHQDSKSKLQMQEKKQINSGVERHKTFPLEIKKKDISLEHLLPEEKVLLSRSESQTKKLQAKVTSRKKTDIESLRGALGRRLLNDEFKTQSKSFPGPDIEQLTDAFGRDILKDEFKTRSKSLPETDERLHSTTERGTINDAIKTQLKRKSYPETVLKHLKGVNGKDIIKHLINIQSKSHGETDKEHLADDTGRGIIKGSINAQLKGHQKTDKNFFAYATGRGLMKESTTTQLKSHPETDKEFLADAIGRGIIIGPITTQLKSHRETDKELLKDAIGRDIIKGPISAQLKSHQETDVEPLTNAIGSSKTIGEIKTQLRTHYDVNLFKNKDMSVQRQEGIFTRSITPSKFPTKVINLSPFENKEETYEYSSPYVTAPSKAIYRTYRAGPSFSKDIHLPLLNQLPSGHSKVVTLSQKTIEFTLPTVTNTVGKPTYKVLHAAARKSVPHPYF

SEQ ID NO: 18684 - protein, 587 aa, Homo sapiens
  Payload ID: 3746
  Gene Symbol: CCDC7
  Gene Name: coiled-coil domain containing 7
  ENSP ID: ENSP00000364170
MEEHSMLMGRKNQYRENGHTAQAHNEVPNERLVVEHQESLSKTKLQIKKQETSTEQPLTTPDKEPNENLILRHQDSMSKSEMQVKEQRTLKGQRIITHDEEPGKNLVLEHQDSVSKLEMQIEKTKKLPREKRHSTHDEESGENPMLKHQDSVSKIQVQLEIQETSEGEGRSIPDKNSMFVHQDSVSKLQMQEKKKITPGRERRNTRIVVPNENVISVHQDSKSKLQMQEKKQINSGVERHKTFPLEIKKKDISLEHLLPEEKVLLSRSESQTKKLQAKVTSRKIKNEAASELPDTAENLPAMYPSISDLIIQFDLNKVVETVLKHLKGVNGKDIIKHLINIQSKSHGETDKNFFAYATGRGLMKESTTTQLKSHPETDKEFLADAIGRGIIIGPITTQLKSHRETDKELLKDAIGRDIIKGPISAQLKSHQETDVEPLTNAIGSSKTIGEIKTQLRTHYDVNLFKNKDMSVQRQEGIFTRSITPSKFPTKVINLSPFENKEETYEYSSPYVTAPSKAIYRTYRAGPSFSKDIHLPLLNQLPSGHSKVVTLSQKTIEFTLPTVTNTVGKPTYKVLHAAARKSVPHPYF

SEQ ID NO: 18685 - protein, 160 aa, Homo sapiens
  Payload ID: 3746
  Gene Symbol: CCDC7
  Gene Name: coiled-coil domain containing 7
  ENSP ID: ENSP00000401923
KTKPTNNRTKKAVKTVKKKDKGKSEDSEKKMSPEKEFKIKEDLDQVQKVARLEIENKVLQEQLKQALQEAEKAKHQLNYFLNQEKLLKSEGKTETTMQVGNSQTKVKGEDSKNIPLEKETRKSLVSDSGGQRTSDKIQEYPQMLIEFLKYFGKVSQTFRE

SEQ ID NO: 18686 - protein, 267 aa, Homo sapiens
  Payload ID: 3746
  Gene Symbol: CCDC7
  Gene Name: coiled-coil domain containing 7
  Uniprot ID: Q96M83
  ENSP ID: ENSP00000436435
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNILESLFKWFQWQVNQMEEISKDQTLLQAEPPKPDKTVILNIAEIVRLVQRFEELKNRLKQRSKSSVKVMLSKTMDKENRPEAVKSCEALAQKIEEFLEAHSTDEFKDVSATEPQL

SEQ ID NO: 18687 - protein, 171 aa, Homo sapiens
  Payload ID: 3746
  Gene Symbol: CCDC7
  Gene Name: coiled-coil domain containing 7
  ENSP ID: ENSP00000439930
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNILESLFKWFQWQVNQMEEG

SEQ ID NO: 18688 - protein, 175 aa, Homo sapiens
  Payload ID: 3746
  Gene Symbol: CCDC7
  Gene Name: coiled-coil domain containing 7
  ENSP ID: ENSP00000440632
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNILESLFKWFQWQVNQMEEKLLIQ

SEQ ID NO: 18689 - protein, 173 aa, Homo sapiens
  Payload ID: 3746
  Gene Symbol: CCDC7
  Gene Name: coiled-coil domain containing 7
  ENSP ID: ENSP00000441041
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNILESLFKWFQWQVNQMEESCK

SEQ ID NO: 18690 - protein, 171 aa, Homo sapiens; identical to SEQ ID NO: 18687
  Payload ID: 3746
  Gene Symbol: CCDC7
  Gene Name: coiled-coil domain containing 7
  ENSP ID: ENSP00000442531

SEQ ID NO: 18691 - protein, 499 aa, Homo sapiens
  Payload ID: 3746
  Gene Symbol: CCDC7
  Gene Name: coiled-coil domain containing 7
  ENSP ID: ENSP00000485403
RRNTRIVVPNENVISVHQDSKSKLQMQEKKQINSGVERHKTFPLEIKKKDISLEHLLPEEKVLLSRSESQTKKLQAKVTSRKIKNEAASELPDTAENLPAMYPSISDLIIQFDLNKVVETDIESLRGALGRRLLNDEFKTQSKSFPGPDIEQLTDAFGRDILKDEFKTRSKSLPETDERLHSTTERGTINDAIKTQLKRKSYPETVLKHLKGVNGKDIIKHLINIQSKSHGETDKEHLADDTGRGIIKGSINAQLKGHQKTDKNFFAYATGRGLMKESTTTQLKSHPETDKEFLADAIGRGIIIGPITTQLKSHRETDKELLKDAIGRDIIKGPISAQLKSHQETDVEPLTNAIGSSKTIGEIKTQLRTHYDVNLFKNKDMSVQRQEGIFTRSITPSKFPTKVINLSPFENKEETYEYSSPYVTAPSKAIYRTYRAGPSFSKDIHLPLLNQLPSGHSKVVTLSQKTIEFTLPTVTNTVGKPTYKVLHAAARKSVPHPYF

SEQ ID NO: 18692 - protein, 233 aa, Homo sapiens
  Payload ID: 3747
  Gene Symbol: CCDC70
  Gene Name: coiled-coil domain containing 70
  Uniprot ID: Q6NSX1
  ENSP ID: ENSP00000242819
MATPPFRLIRKMFSFKVSRWMGLACFRSLAASSPSIRQKKLMHKLQEEKAFREEMKIFREKIEDFREEMWTFRGKIHAFRGQILGFWEEERPFWEEEKTFWKEEKSFWEMEKSFREEEKTFWKKYRTFWKEDKAFWKEDNALWERDRNLLQEDKALWEEEKALWVEERALLEGEKALWEDKTSLWEEENALWEEERAFWMENNGHIAGEQMLEDGPHNANRGQRLLAFSRGRA

SEQ ID NO: 18693 - protein, 467 aa, Homo sapiens
  Payload ID: 3748
  Gene Symbol: CCDC71
  Gene Name: coiled-coil domain containing 71
  Uniprot ID: Q8IV32
  ENSP ID: ENSP00000319006
MSVVVQHVEEKAVHSWSRISTAGKKALEEALLVFNPMSQDLSATEAQLVAFLQGLRDDGFQPTILRSGDVYGYSSCTANPPSQTKLQARAPNPTATSPPASAPRTAMRLPAGRATLLPMPLSGRLAKASTPALAKHATTNLLLSSLKQSSASHARGAAVGFPTHLYPGVYPAMRLSVVLEALVPLKTPMPCLGAKHKAQSLQLSLADSPLKLRKSSGKGPGNPRPKAPRKTTSKGPKCLTRKGPGAGPRRGSGHQSKTNRATGSPSVRRMKGGSALGTKTAQAKVARTLAKAARAQAKVARTQAKAAKARAKAKAAQVKAKAKAKAAQVKAKAKVMAAWAKAKAKAKAVRAKAKVARTQPRGRGRPKGSAKARTTRKGQKNRPETVGQKRKRAEEAKDLPPKKRTRLGPRSPKAWLGPGTAKLLKFRAIKVDRRSSDDEVRQRAQRILRVNLSPVIRLQPLLPYSAV

SEQ ID NO: 18694 - protein, 235 aa, Homo sapiens
  Payload ID: 3749
  Gene Symbol: CCDC71L
  Gene Name: coiled-coil domain containing 71-like
  Uniprot ID: Q8N9Z2
  ENSP ID: ENSP00000430897
MRRSMKRRRRRRPVAPATAARGGDFRAEDGAGLEAREEKVVYSRSQLSLADSTKALGDAFKLFMPRSTEFMSSDAELWSFLCSLKHQFSPHILRSKDVYGYSSCRALVPDPPGPPTARGQARRPVPRAAARRRRRGARAAAARRRKPRPPPPPPPPPEESCPAKPVAPGPCFGGRTLEEIWRAATPTLTTFPTIRVGSDVWGERSLAAARRRARQVLRVNLEPMVRLRRFPVPRA

SEQ ID NO: 18695 - protein, 316 aa, Homo sapiens
  Payload ID: 3749
  Gene Symbol: CCDC71L
  Gene Name: coiled-coil domain containing 71-like
  ENSP ID: ENSP00000479540
MKRRRRRRPVAPATAARGGDFRAEDGAGLEAREEKVVYSRSQLSLADSTKALGDAFKLFMPRSTEFMSSDAELWSFLCSLKHQFSPHILRSKDVYGYSPYSPRPGAPAGSARSGQEEAPRSPGGRCPQEEAPAATPTAAAPRGELPGQARGPRALLRGPHLGGDLEGGHPDADHLPHHPRRQRRVGRAQPGGSAAQGAPGPASEPGTHGEAPPLPGAPGMRCGLQGASCRPRPWDRPSARRNEQVSVECLQIRPGPRPPMHFTREEVAGWLSLSRAAARSSWTLGQVCPLLPPVPGLRREGTAGPAGEVPFFLTTD

SEQ ID NO: 18696 - protein, 1079 aa, Homo sapiens
  Payload ID: 3750
  Gene Symbol: CCDC73
  Gene Name: coiled-coil domain containing 73
  Uniprot ID: Q6ZRK6
  ENSP ID: ENSP00000335325
MESNFNTESSSTFTLQSSSETLFSIQLLDFKTSLLEALEELRMRREAEIHYEEQIGKIIVETQELKWQKETLQNQKETLAEQHKEAMAVFKKQLQMKMCALEEEKGKYQLATEIKEKEIEGLKETLKALQVSKYSLQKKVSEMEQKVQLHLLAKEDYHKQLSEIEKYYATITGQFGLVKENHEKLEQNVREAIQSNKRLSALNKKQEAEICSLKKELKKAASDLIKSKVTCQYKMGEENINLTIKEQKFQELQERLNMELELNEKINEEITHIQEEKQDIIISFQHMQQLLRQQIQANTEMEAELKVLKENNQTLERDNELQREKVKENEEKFLNLQNEHEKALGTWKRHAEELNGEINKIKNELSSLKETHIKLQEHYNKLCNQKTFEEDKKFQNVPEVNNENSEMSTEKSENTIIQKYNTEQEIREENMENFCSDTEYREKEEKKEGSFIEEIIIDDLQLFEKSFKNEIDTVVSQDENQSEISLSKTLSLDKEVISQGQTSNVTDNRKSVTTEIKDKICLEKDNGCTEFKSPNNHFVVLDTAIETEKIHLERTRGLDVHHTDVNLEVENNKTSFNSILNETAHNTYHNNNKDVSENEPFKQFRLLPGTREHALEKEITNSDQTKADLDSSLDIKKNPVPCQKYSLRNSSNVMLDDKQCKIKQIQLLTKKSECSILLSKQTSDFLQVCNDTLEKSELTVPCDIVIDHHVSYAAFSANSKLLLKNSDKNVHSMSMLVKPNSSPGGKTMCKNMSDMQNSQFNNCLGYLENTNVNISHLHLNNENSHASQAKDVKTAVHMKTCTETEFSNKKNQIDENQVTEATKNDLFLFVSINERQHTLLNNTEKTESLNDIVSGKMFSEGQLEESHSFHIEPSGDLVNRSGRSTFDLSTSDKKTEKTPVYMNFSDPGPWSKVNHIESQTASSSTPCISLLLKERPLDPSENKKIISMALCKNIGVDDVGKDIGPDTTSINRVADTLNNWSIHPDPKGEPSEEKNAMAKTFYDSSFPTEHVKTKPLISTPLQSHLQAIKTTKNTSGDDDWQSLITNQLNKSENLLSLENDNQPKKRKAEETLEKNNRLK

SEQ ID NO: 18697 - protein, 115 aa, Homo sapiens
  Payload ID: 3750
  Gene Symbol: CCDC73
  Gene Name: coiled-coil domain containing 73
  ENSP ID: ENSP00000434365
  MOD_RES (1)..(1): Any amino acid
XAEELNGEINKIKNELSSLKETHIKLQEHYNKLCNQKTFEEDKKFQVKTKPLISTPLQSHLQAIKTTKNTSGDDDWQSLITNQLNKSENLLSLENDNQPKKRKAEETLEKNNRLK

SEQ ID NO: 18698 - protein, 158 aa, Homo sapiens
  Payload ID: 3750
  Gene Symbol: CCDC73
  Gene Name: coiled-coil domain containing 73
  ENSP ID: ENSP00000436440
MESNFNTESSSTFTLQSSSETLFSIQLLDFKTSLLEALEELRMRREAEIHYEEQIGKIIVETQELKWQKETLQNQKETLAEQHKEAMAVFKKQLQMKMCALEEEKGKYQLATEIKEKEIEGLKETLKALQVSKYSLQKKVSEMVRKLQNIFSPIWIST

SEQ ID NO: 18699 - protein, 378 aa, Homo sapiens
  Payload ID: 3751
  Gene Symbol: CCDC74A
  Gene Name: coiled-coil domain containing 74A
  Uniprot ID: Q96AQ1
  ENSP ID: ENSP00000295171
MSGAGVAAGTRPPSSPTPGSRRRRQRPSVGVQSLRPQSPQLRQSDPQKRNLDLEKSLQFLQQQHSEMLAKLHEEIEHLKRENKDLHYKLIMNQTSQKKDGPSGNHLSRASAPLGARWVCINGVWVEPGGPSPARLKEGSSRTHRPGGKRGRLAGGSADTVRSPADSLSMSSFQSVKSISNSGKARPQPGSFNKQDSKADVSQKADLEEEPLLHNSKLDKVPGVQGQARKEKAEASNAGAACMGNSQHQGRQMGAGAHPPMILPLPLRKPTTLRQCEVLIRELWNTNLLQTQELRHLKSLLEGSQRPQAAPEEASFPRDQEATHFPKVSTKSLSKKCLSPPVAERAILPALKQTPKNNFAERQKRLQAMQKRRLHRSVL

SEQ ID NO: 18700 - protein, 312 aa, Homo sapiens
  Payload ID: 3751
  Gene Symbol: CCDC74A
  Gene Name: coiled-coil domain containing 74A
  Uniprot ID: Q96AQ1
  ENSP ID: ENSP00000387009
MSGAGVAAGTRPPSSPTPGSRRRRQRPSVGVQSLRPQSPQLRQSDPQKRNLDLEKSLQFLQQQHSEMLAKLHEEIEHLKRENKDLHYKLIMNQTSQKKDSLSMSSFQSVKSISNSGKARPQPGSFNKQDSKADVSQKADLEEEPLLHNSKLDKVPGVQGQARKEKAEASNAGAACMGNSQHQGRQMGAGAHPPMILPLPLRKPTTLRQCEVLIRELWNTNLLQTQELRHLKSLLEGSQRPQAAPEEASFPRDQEATHFPKVSTKSLSKKCLSPPVAERAILPALKQTPKNNFAERQKRLQAMQKRRLHRSVL

SEQ ID NO: 18701 - protein, 135 aa, Homo sapiens
  Payload ID: 3751
  Gene Symbol: CCDC74A
  Gene Name: coiled-coil domain containing 74A
  ENSP ID: ENSP00000388252
MSGAGVAAGTRPPSSPTPGSRRRRQRPSVGVQSLRPQSPQLRQSDPQKRNLDLEKSLQFLQQQHSEMLAKLHEEIEHLKRENKGEPARGPRPALPPQAHSTLPLPQHRNTAINSSTRLGSGGTQDGSDTPLLKTL

SEQ ID NO: 18702 - protein, 206 aa, Homo sapiens
  Payload ID: 3751
  Gene Symbol: CCDC74A
  Gene Name: coiled-coil domain containing 74A
  ENSP ID: ENSP00000406839
MDEADMPGGLCLGNRQGHSWPDTHDEGVVESGIHGAGPNQPVGGQDFWAQQPGEDRPGFFSQNSCGFTSAEESVCLLSDLHYKLIMNQTSQKKDSLSMSSFQSVKSISNSGKARPQPGSFNKQDSKADVSQKADLEEEPLLHNSKLDKVPGVQGQASPPHLGSAKCSSASCGIPTSCRPKSCGTSSPSWKGARGPRQPRRKLAFPG

SEQ ID NO: 18703 - protein, 272 aa, Homo sapiens
  Payload ID: 3751
  Gene Symbol: CCDC74A
  Gene Name: coiled-coil domain containing 74A
  ENSP ID: ENSP00000444610
MSGAGVAAGTRPPSSPTPGSRRRRQRPSVGVQSLRPQSPQLRQSDPQKRNLDLEKSLQFLQQQHSEMLAKLHEEIEHLKRENKDLHYKLIMNQTSQKKDGPSGNHLSRASAPLGARWVCINGVWVEPGGPSPARLKEGSSRTHRPGGKRGRLAGGSADTVRSPADSLSMSSFQSVKSISNSGKARPQPGSFNKQDSKADVSQKADLEEEPLLHNSKLDKVPGVQGQASCGTSSPSWKGARGPRQPRRKLAFPGTKKPRISPRSPPRASPRNA

SEQ ID NO: 18704 - protein, 380 aa, Homo sapiens
  Payload ID: 3752
  Gene Symbol: CCDC74B
  Gene Name: coiled-coil domain containing 74B
  Uniprot ID: Q96LY2
  ENSP ID: ENSP00000308873
MSGAGVAAGTRPPSSPTPGSRRRRQRPSVGVQSLRPQSPQLRQSDPQKRNLDLEKSLQFLQQQHSEMLAKLHEEIEHLKRENKDLRYKLIMNQTSQKKDGPSGNHLSRASAPLGARWVCINGVWVEPGGPSPARLKEGSSRTHRPGGKHGRLAGGSADTVRSPADSLSTSSFQSVKSISNSGKARPQPGSFNKQDSKADVPQKADLEEEPLLHNSKLDKVPGVQGQARKEKAEASNAGAACMGNSQHQGRQMGAAAHPPMILPLPLRKPTTLRQCEVLIRELWNTNLLQTQELQHLKSLLEGSQRPQAVPEEASFPRDQEATHFPKVSTKSLSKKCLLLSPPVAERAILPALKQTPKNNFAERQKRLQAMQKRRLHRSVL

SEQ ID NO: 18705 - protein, 274 aa, Homo sapiens
  Payload ID: 3752
  Gene Symbol: CCDC74B
  Gene Name: coiled-coil domain containing 74B
  ENSP ID: ENSP00000376710
MSGAGVAAGTRPPSSPTPGSRRRRQRPSVGVQSLRPQSPQLRQSDPQKRNLDLEKSLQFLQQQHSEMLAKLHEEIEHLKRENKDLRYKLIMNQTSQKKDGPSGNHLSRASAPLGARWVCINGVWVEPGGPSPARLKEGSSRTHRPGGKHGRLAGGSADTVRSPADSLSTSSFQSVKSISNSGKARPQPGSFNKQDSKADVPQKADLEEEPLLHNSKLDKVPGVQGQASCSTSSPSWKGARGPRQSRRKLAFPGTKKPRISPRSPPRASPRNACF

SEQ ID NO: 18706 - protein, 314 aa, Homo sapiens
  Payload ID: 3752
  Gene Symbol: CCDC74B
  Gene Name: coiled-coil domain containing 74B
  Uniprot ID: Q96LY2
  ENSP ID: ENSP00000386294
MSGAGVAAGTRPPSSPTPGSRRRRQRPSVGVQSLRPQSPQLRQSDPQKRNLDLEKSLQFLQQQHSEMLAKLHEEIEHLKRENKDLRYKLIMNQTSQKKDSLSTSSFQSVKSISNSGKARPQPGSFNKQDSKADVPQKADLEEEPLLHNSKLDKVPGVQGQARKEKAEASNAGAACMGNSQHQGRQMGAAAHPPMILPLPLRKPTTLRQCEVLIRELWNTNLLQTQELQHLKSLLEGSQRPQAVPEEASFPRDQEATHFPKVSTKSLSKKCLLLSPPVAERAILPALKQTPKNNFAERQKRLQAMQKRRLHRSVL

SEQ ID NO: 18707 - protein, 225 aa, Homo sapiens
  Payload ID: 3752
  Gene Symbol: CCDC74B
  Gene Name: coiled-coil domain containing 74B
  ENSP ID: ENSP00000386303
MSGAGVAAGTRPPSSPTPGSRRRRQRPSVGVQSLRPQSPQLRQSDPQKRNLDLEKSLQFLQQQHSEMLAKLHEEIEHLKRENKDLRYKLIMNQTSQKKGENWALQFLMGCSCHPGEPLQTVLAHLAALAPVCQPSGDRFWGTWTDAATSSRGWMMLRSQAQHVLLSGSPGPEVIAVGRWAQGAPQTSLLQVELKWEGTPGTAPALLDLCLRLLLWPGPGSPALWL

SEQ ID NO: 18708 - protein, 204 aa, Homo sapiens
  Payload ID: 3752
  Gene Symbol: CCDC74B
  Gene Name: coiled-coil domain containing 74B
  ENSP ID: ENSP00000386644
MSGAGVAAGTRPPSSPTPGSRRRRQRPSVGVQSLRPQSPQLRQSDPQKRNLDLEKSLQFLQQQHSEMLAKLHEEIEHLKRENKGEPARGPRPALPPQAHSTLPLPQHRNTAINSSTRLGSGGTQDDLRYKLIMNQTSQKKDSLSTSSFQSVKSISNSGKARPQPGSFNKQDSKADVPQKADLEEEPLLHNSKLDKVPGVQGQAR

SEQ ID NO: 18709 - protein, 159 aa, Homo sapiens
  Payload ID: 3752
  Gene Symbol: CCDC74B
  Gene Name: coiled-coil domain containing 74B
  ENSP ID: ENSP00000396549
MSGAGVAAGTRPPSSPTPGSRRRRQRPSVGVQSLRPQSPQLRQSDPQKRNLDLEKSLQFLQQQHSEMLAKLHEEIEHLKRENKGEPARGPRPALPPQAHSTLPLPQHRNTAINSSTRLGSGGTQDDLRYKLIMNQTSQKKGENWALQFLMGCSCHPGEP

SEQ ID NO: 18710 - protein, 205 aa, Homo sapiens
  Payload ID: 3752
  Gene Symbol: CCDC74B
  Gene Name: coiled-coil domain containing 74B
  ENSP ID: ENSP00000399683
  MOD_RES (1)..(1): Any amino acid
XSGAGVAAGTRPPSSPTPGSRRRRQRPSVGVQSLRPQSPQLRQSDPQKRNLDLEKSLQFLQQQHSEMLAKLHEEIEHLKRENKGEPARGPRPALPPQAHSTLPLPQHRNTAINSSTRLGSGGTQDDLRYKLIMNQTSQKKDGPSGNHLSRASAPLGARWVCINGVWVEPGGPSPARLKEGSSRTHRPGGKHGRLAGGSADTVRSP

SEQ ID NO: 18711 - protein, 93 aa, Homo sapiens
  Payload ID: 3752
  Gene Symbol: CCDC74B
  Gene Name: coiled-coil domain containing 74B
  ENSP ID: ENSP00000404494
MSGAGVAAGTRPPSSPTPGSRRRRQRPSVGVQSLRPQSPQLRQSDPQKRNLDLEKSLQFLQQQHSEMLAKLHEEIEHLKRENKGSDTPLLKTL

SEQ ID NO: 18712 - protein, 115 aa, Homo sapiens
  Payload ID: 3752
  Gene Symbol: CCDC74B
  Gene Name: coiled-coil domain containing 74B
  ENSP ID: ENSP00000410864
MSGAGVAAGTRPPSSPTPGSRRRRQRPSVGVQSLRPQSPQLRQSDPQKRNLDLEKSLQFLQQQHSEMLAKLHEEIEHLKRENKDLRYKLIMNQTSQKKGPLLPWALAGSASTECG

SEQ ID NO: 18713 - protein, 488 aa, Homo sapiens
  Payload ID: 3753
  Gene Symbol: CCDC77
  Gene Name: coiled-coil domain containing 77
  Uniprot ID: Q9BR77
  ENSP ID: ENSP00000239830
MNFTPTHTPVCRKRTVVSKRGVAVSGPTKRRGMADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKSLKDKLVQEKKLSNMYQEQCISLEEELARIREEEGMRREIFKDRTNKMGKRLQIMTKRYEALERRRILEVEGFKTDIKVLRQKLKDLEQMLYKATVNARANQDLALLCEVRDSNRRAHKIQGELKNLKSKVFGLENELRLC

SEQ ID NO: 18714 - protein, 456 aa, Homo sapiens
  Payload ID: 3753
  Gene Symbol: CCDC77
  Gene Name: coiled-coil domain containing 77
  Uniprot ID: Q9BR77
  ENSP ID: ENSP00000391870
MADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKSLKDKLVQEKKLSNMYQEQCISLEEELARIREEEGMRREIFKDRTNKMGKRLQIMTKRYEALERRRILEVEGFKTDIKVLRQKLKDLEQMLYKATVNARANQDLALLCEVRDSNRRAHKIQGELKNLKSKVFGLENELRLC

SEQ ID NO: 18715 - protein, 456 aa, Homo sapiens; identical to SEQ ID NO: 18714
  Payload ID: 3753
  Gene Symbol: CCDC77
  Gene Name: coiled-coil domain containing 77
  Uniprot ID: Q9BR77
  ENSP ID: ENSP00000412925

SEQ ID NO: 18716 - protein, 456 aa, Homo sapiens; identical to SEQ ID NO: 18714
  Payload ID: 3753
  Gene Symbol: CCDC77
  Gene Name: coiled-coil domain containing 77
  Uniprot ID: Q9BR77
  ENSP ID: ENSP00000440554

SEQ ID NO: 18717 - protein, 92 aa, Homo sapiens
  Payload ID: 3753
  Gene Symbol: CCDC77
  Gene Name: coiled-coil domain containing 77
  ENSP ID: ENSP00000443209
MNFTPTHTPVCRKRTVVSKRGVAVSGPTKRRGMADSLESTPLPSPEDRLAKLHPSKELLEYYQKKMAECEAENEDLLKKLELYKEACEGQHK

SEQ ID NO: 18718 - protein, 386 aa, Homo sapiens
  Payload ID: 3753
  Gene Symbol: CCDC77
  Gene Name: coiled-coil domain containing 77
  ENSP ID: ENSP00000445873
MADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKSLKDKLVQEKKLSNMYQEQCISLEEELARIREEEGMRREIFKDRTNKMGKRLQIMTKRYEALERRRILEVE

SEQ ID NO: 18719 - protein, 438 aa, Homo sapiens
  Payload ID: 3754
  Gene Symbol: CCDC78
  Gene Name: coiled-coil domain containing 78
  Uniprot ID: A2IDD5
  ENSP ID: ENSP00000293889
MEHAATTGPRPGPPSRRVENVVLRAKDWLPGAPGGTAVWATSLEAEVPPDLALNKEQQLQISKELVDIQITTHHLHEQHEAEIFQLKSEILRLESRVLELELRGDGTSQGCAVPVESDPRHPRAAAQELRHKAQVPGHSDDHRFQVQPKNTMNPENEQHRLGSGLQGEVKWALEHQEARQQALVTRVATLGRQLQGAREEARAAGQRLATQAVVLCSCQGQLRQAEAENARLQLQLKKLKDEYVLRLQHCAWQAVEHADGAGQAPATTALRTFLEATLEDIRAAHRSREQQLARAARSYHKRLVDLSRRHEELLVAYRAPGNPQAIFDIASLDLEPLPVPLVTDFSHREDQHGGPGALLSSPKKRPGGASQGGTSEPQGLDAASWAQIHQKLRDFSRSTQSWNGSGHSCWSGPRWLKSNFLSYRSTWTSTWAGTSTKS

SEQ ID NO: 18720 - protein, 319 aa, Homo sapiens
  Payload ID: 3754
  Gene Symbol: CCDC78
  Gene Name: coiled-coil domain containing 78
  ENSP ID: ENSP00000316851
  MOD_RES (1)..(1): Any amino acid
XNPENEQHRLGSGLQGEVKWALEHQEARQQALVTRVATLGRQLQGAREEARAAGQRLATQAVVLCSCQGQLRQAEAENARLQLQLKKLKDEYVLRLQHCAWQAVEHADGAGQAPATTALRTFLEATLEDIRAAHRSREQQLARAARSYHKRLVDLSRRHEELLVAYRAPGNPQAIFDIASLDLEPLPVPLVTDFSHREDQHGGPGALLSSPKKRPGGASQGGTSEPQGLDAASWAQIHQKLRDFSRSTQAELERERAQLLVRATMAEEQLSELQEYVDQHLGRYKHEILRLRKLAGAGDPWKVGAVPPAKPQHPRTGSH

SEQ ID NO: 18721 - protein, 56 aa, Homo sapiens
  Payload ID: 3754
  Gene Symbol: CCDC78
  Gene Name: coiled-coil domain containing 78
  ENSP ID: ENSP00000458590
MNPENEQHRLGSGLQGEVKWALEHQEARQQALVTRVATLGRQLQGAREEARAAGQR

SEQ ID NO: 18722 - protein, 110 aa, Homo sapiens
  Payload ID: 3755
  Gene Symbol: CCDC79
  Gene Name: coiled-coil domain containing 79
  ENSP ID: ENSP00000462482
MESEDTKKTQEMKTDLNLLLECLKYQMDNAFSQKEALVTIHSICQQNSNASVYFREIGGLMFVKNLAKSSEHSMVKEAALYTLGAIAEKNVYCQQTLCTSELFEDLTWFL

SEQ ID NO: 18723 - protein, 25 aa, Homo sapiens
  Payload ID: 3755
  Gene Symbol: CCDC79
  Gene Name: coiled-coil domain containing 79
  ENSP ID: ENSP00000462842
  MOD_RES (1)..(1): Any amino acid
XKVIVEAEDRYKSELRKSLICNKSN

SEQ ID NO: 18724 - protein, 727 aa, Homo sapiens
  Payload ID: 3755
  Gene Symbol: CCDC79
  Gene Name: coiled-coil domain containing 79
  Uniprot ID: Q8NA31
  ENSP ID: ENSP00000462883
MESEDTKKTQEMKTDLNLLLECLKYQMDNAFSQKEALVTIHSICQQNSNASVYFREIGGLMFVKNLAKSSEHSMVKEAALYTLGAIAEKNVYCQQTLCTSELFEDLTWFLSNDSNINLKRMSVYVILVLVSNNRTGQTLVRETGCITVLSRLFRTVISKHELDLSDKNVFQSYQLWSSVCSTLCVCVNNPQNDENQMFCCSLFPHANEWLKNCTTPEIIRPICSFIGLTLANNTYVQKYFVSVGGLDVLSQVLMQLESDSHETLSSAKLAVVVTKTVDACIADNPTFGIVLSKYHIVSKLLALLLHESLDSGEKFSIMLTLGHCTEDCEENQYDLFKNNGLPLMIQALTESQNEELNKAATFVLHNCKKITEKLSLSLGEYPFDENETQQLKDISVKENNLEEHWRKAKEILHRIEQLEREGNEEEIQRENYQDNISSMNISIQNTWKHLHADRIGRGSKAEDEDKSHSRQLQSYKSHGVMSKACTNDDQMKTPLKSANPVHACYRESEQNKTLYKAKSSCNQNLHEETTFEKNFVSQSSDHVFKHPVHIAKNIKQQLPVTDPFTLCSDIINKEVVSFLATPSCSEMLTYRCSGCIAVEKSLNSRNFSKLLHSCPYQCDRHKVIVEAEDRYKSELRKSLICNKKILLTPRRRQRLSNESTTPGGIKKRRIRKNFTEEEVNYLFNGVKKMGNHWNSILWSFPFQQGRKAVDLAHKYHKLTKHPTCAAS

SEQ ID NO: 18725 - protein, 727 aa, Homo sapiens; identical to SEQ ID NO: 18724
  Payload ID: 3755
  Gene Symbol: CCDC79
  Gene Name: coiled-coil domain containing 79
  Uniprot ID: Q8NA31
  ENSP ID: ENSP00000463762

SEQ ID NO: 18726 - protein, 508 aa, Homo sapiens
  Payload ID: 3755
  Gene Symbol: CCDC79
  Gene Name: coiled-coil domain containing 79
  Uniprot ID: Q8NA31
  ENSP ID: ENSP00000464579
MESEDTKKTQEMKTDLNLLLECLKYQMDNAFSQKEALVTIHSICQQNSNASVYFREIGGLMFVKNLAKSSEHSMVKEAALYTLGAIAEKNVYCQQTLCTSELFEDLTWFLSNDSNINLKRMSVYVILVLVSNNRTGQTLVRETGCITVLSRLFRTVISKHELDLSDKNVFQSYQLWSSVCSTLCVCVNNPQNDENQMFCCSLFPHANEWLKNCTTPEIIRPICSFIGLTLANNTYVQKYFVSVGGLDVLSQVLMQLESDSHETLSSAKLAVVVTKTVDACIADNPTFGIVLSKYHIVSKLLALLLHESLDSGEKFSIMLTLGHCTEDCAEKLSLSLGEYPFDENETQQLKDISVKENNLEEHWRKAKEILHRIEQLEREGNEEEIQRENYQDNISSMNISIQNTWKHLHADRIGRGSKAEDEDKSHSRQLQSYKSHGVMSKACTNDDQMKTPLKSANPVHACYRESEQNKTLYKAKSSCNQNLHEETTFEKNFVSQSRSIYIMFRYNK

SEQ ID NO: 18727 - protein, 538 aa, Homo sapiens
  Payload ID: 3756
  Gene Symbol: CCDC8
  Gene Name: coiled-coil domain containing 8
  Uniprot ID: Q9H0W5
  ENSP ID: ENSP00000303158
MLQIGEDVDYLLIPREVRLAGGVWRVISKPATKEAEFRERLTQFLEEEGRTLEDVARIMEKSTPHPPQPPKKPKEPRVRRRVQQMVTPPPRLVVGTYDSSNASDSEFSDFETSRDKSRQGPRRGKKVRKMPVSYLGSKFLGSDLESEDDEELVEAFLRRQEKQPSAPPARRRVNLPVPMFEDNLGPQLSKADRWREYVSQVSWGKLKRRVKGWAPRAGPGVGEARLASTAVESAGVSSAPEGTSPGDRLGNAGDVCVPQASPRRWRPKINWASFRRRRKEQTAPTGQGADIEADQGGEAADSQREEAIADQREGAAGNQRAGAPADQGAEAADNQREEAADNQRAGAPAEEGAEAADNQREEAADNQRAEAPADQRSQGTDNHREEAADNQRAEAPADQGSEVTDNQREEAVHDQRERAPAVQGADNQRAQARAGQRAEAAHNQRAGAPGIQEAEVSAAQGTTGTAPGARARKQVKTVRFQTPGRFSWFCKRRRAFWHTPRLPTLPKRVPRAGEARNLRVLRAEARAEAEQGEQEDQL

SEQ ID NO: 18728 - protein, 950 aa, Homo sapiens
  Payload ID: 3757
  Gene Symbol: CCDC80
  Gene Name: coiled-coil domain containing 80
  Uniprot ID: Q76M96
  ENSP ID: ENSP00000206423
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPALPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGYQDDYRHHESYHHGYPY

SEQ ID NO: 18729 - protein, 950 aa, Homo sapiens; identical to SEQ ID NO: 18728
  Payload ID: 3757
  Gene Symbol: CCDC80
  Gene Name: coiled-coil domain containing 80
  Uniprot ID: Q76M96
  ENSP ID: ENSP00000411814

SEQ ID NO: 18730 - protein, 212 aa, Homo sapiens
  Payload ID: 3757
  Gene Symbol: CCDC80
  Gene Name: coiled-coil domain containing 80
  ENSP ID: ENSP00000418188
MALRSMGQFSVFFFFFFWAQKKIASLSHSGFLHWFLLFEAVSSNGVLLFFSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGY

SEQ ID NO: 18731 - protein, 261 aa, Homo sapiens
  Payload ID: 3757
  Gene Symbol: CCDC80
  Gene Name: coiled-coil domain containing 80
  ENSP ID: ENSP00000420123
  MOD_RES (1)..(1): Any amino acid
XFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGSSVVEREDVPAHLVKDIRNYFQVSPEYFSMLLVGKDGNVKSWYPSPMWSMVIVY

SEQ ID NO: 18732 - protein, 562 aa, Homo sapiens
  Payload ID: 3758
  Gene Symbol: CCDC81
  Gene Name: coiled-coil domain containing 81
  Uniprot ID: Q6ZN84
  ENSP ID: ENSP00000346800
MLDTIARALQDLGRQVLPTLPSLSQEEVSIIWGNVSEFVRRQLTLHKGVQIPAFGTFTFIRQKLEVGNNKFILIQRPVFIMVEKLVQIHGLKQNKRPGTVDSVLSSREALRKWPSSVLAFPRIELKEMENKLPMETLVEECGENRERKCKLKDQSDKEEGTRDISSPKRLRDRQALFPAKVTNVSLLEKFERSESGGKIMTPESLSYPSCLKHDSEMKPQTSPACQDHNKAGQEMCYVCLQRAQRNSLLYYSEERRREIEDERLIQQYQMLKDQEALFRHQMKSLATREQNQKNAAYNLGVAEAIRNHKNEKPEFYKSFLFDKRPLSPALNALKQEEYSRSLLKQMDNRQENEIKQRQYRELMDRLEQVQLTEELAAQRAKFLKDKMEETQCYKRALDAQIKNKPSRLPPFEPDSSEPIFGKNEGELMVEKQKREQNYMKHQLEAAANHKRKAILHQLVDQRRDLQMLQRTQREHLADRTAELERVNRVNQCLQEDWERSAAMKKQRDLEDKAFERASDKLFLLDQCEKYRRCKQCQRRTSNVGESNLWPLNKFLPGSRLLV

SEQ ID NO: 18733 - protein, 652 aa, Homo sapiens
  Payload ID: 3758
  Gene Symbol: CCDC81
  Gene Name: coiled-coil domain containing 81
  Uniprot ID: Q6ZN84
  ENSP ID: ENSP00000415528
MLDTIARALQDLGRQVLPTLPSLSQEEVSIIWGNVSEFVRRQLTLHKGVQIPAFGTFTFIRQKLEVGNNKFILIQRPVFIMVEKLVQIHGLKQNKVYTPGEIPIVPLNFVMISLEGPFNRDVVEGCVKETLLFLSRSISMKQNVEFTFKGIGVLMIRDSKVKMRFYKDFLCTMDGSGALAKALANRPGTVDSVLSSREALRKWPSSVLAFPRIELKEMENKLPMETLVEECGENRERKCKLKDQSDKEEGTRDISSPKRLRDRQALFPAKVTNVSLLEKFERSESGGKIMTPESLSYPSCLKHDSEMKPQTSPACQDHNKAGQEMCYVCLQRAQRNSLLYYSEERRREIEDERLIQQYQMLKDQEALFRHQMKSLATREQNQKNAAYNLGVAEAIRNHKNEKPEFYKSFLFDKRPLSPALNALKQEEYSRSLLKQMDNRQENEIKQRQYRELMDRLEQVQLTEELAAQRAKFLKDKMEETQCYKRALDAQIKNKPSRLPPFEPDSSEPIFGKNEGELMVEKQKREQNYMKHQLEAAANHKRKAILHQLVDQRRDLQMLQRTQREHLADRTAELERVNRVNQCLQEDWERSAAMKKQRDLEDKAFERASDKLFLLDQCEKYRRCKQCQRRTSNVGESNLWPLNKFLPGSRLLV

SEQ ID NO: 18734 - protein, 88 aa, Homo sapiens
  Payload ID: 3758
  Gene Symbol: CCDC81
  Gene Name: coiled-coil domain containing 81
  ENSP ID: ENSP00000434959
MLDTIARALQDLGRQVLPTLPSLSQEEVSIIWGNVSEFVRRQLTLHKRPGTVDSVLSSREALRKWPSSVLAFPRIELKEMENKLPMET

SEQ ID NO: 18735 - protein, 387 aa, Homo sapiens
  Payload ID: 3758
  Gene Symbol: CCDC81
  Gene Name: coiled-coil domain containing 81
  Uniprot ID: Q6ZN84
  ENSP ID: ENSP00000437165
MENKLPMETLVEECGENRERKCKLKDQSDKEEGTRDISSPKRLRDRQALFPAKVTNVSLLEKFERSESGGKIMTPESLSYPSCLKHDSEMKPQTSPACQDHNKAGQMKSLATREQNQKNAAYNLGVAEAIRNHKNEKPEFYKSFLFDKRPLSPALNALKQEEYSRSLLKQMDNRQENEIKQRQYRELMDRLEQVQLTEELAAQRAKFLKDKMEETQCYKRALDAQIKNKPSRLPPFEPDSSEPIFGKNEGELMVEKQKREQNYMKHQLEAAANHKRKAILHQLVDQRRDLQMLQRTQREHLADRTAELERVNRVNQCLQEDWERSAAMKKQRDLEDKAFERASDKLFLLDQCEKYRRCKQCQRRTSNVGESNLWPLNKFLPGSRLLV

SEQ ID NO: 18736 - protein, 544 aa, Homo sapiens
  Payload ID: 3759
  Gene Symbol: CCDC82
  Gene Name: coiled-coil domain containing 82
  Uniprot ID: Q8N4S0
  ENSP ID: ENSP00000278520
MIHVRRHETRRNSKSHVPEQKSRVDWRRTKRSSISQLLDSDEELDSEEFDSDEELDSDESFENDEELDSNKGPDCNKTPGSERELNLSKIQSEGNDSKCLINSGNGSTYEEETNKIKHRNIDLQDQEKHLSQEDNDLNKQTGQIIEDDQEKHLSQEDNDLNKQTGQIIEDDLEEEDIKRGKRKRLSSVMCDSDESDDSDILVRKVGVKRPRRVVEDEGSSVEMEQKTPEKTLAAQKREKLQKLKELSKQRSRQRRSSGRDFEDSEKESCPSSDEVDEEEEEDNYESDEDGDDYIIDDFVVQDEEGDEENKNQQGEKLTTSQLKLVKQNSLYSFSDHYTHFERVVKALLINALDESFLGTLYDGTRQKSYAKDMLTSLHYLDNRFVQPRLESLVSRSRWKEQYKERVENYSNVSIHLKNPENCSCQACGLHRYCKYSVHLSGELYNTRTMQIDNFMSHDKQVFTVGRICASRTRIYHKLKHFKFKLYQECCTIAMTEEVEDEQVKETVERIFRRSKENGWIKEKYGQLEEYLNFADYFQEEKFEL

SEQ ID NO: 18737 - protein, 544 aa, Homo sapiens; identical to SEQ ID NO: 18736
  Payload ID: 3759
  Gene Symbol: CCDC82
  Gene Name: coiled-coil domain containing 82
  Uniprot ID: Q8N4S0
  ENSP ID: ENSP00000397156

SEQ ID NO: 18738 - protein, 30 aa, Homo sapiens
  Payload ID: 3759
  Gene Symbol: CCDC82
  Gene Name: coiled-coil domain containing 82
  ENSP ID: ENSP00000431148
MIHVRRHETRRNSKSHVPEQKSRVDWRRTK

SEQ ID NO: 18739 - protein, 262 aa, Homo sapiens
  Payload ID: 3759
  Gene Symbol: CCDC82
  Gene Name: coiled-coil domain containing 82
  ENSP ID: ENSP00000442723
MIHVRRHETRRNSKSHVPEQKSRVDWRRTKRSSISQLLDSDEELDSEEFDSDEELDSDESFENDEELDSNKGPDCNKTPGSERELNLSKIQSEGNDSKCLINSGNGSTYEEETNKIKHRNIDLQDQEKHLSQEDNDLNKQTGQIIEDDQEKHLSQEDNDLNKQTGQIIEDDLEEEDIKRGKRKRLSSVMCDSDESDDSDILVRKVGVKRPRRVVEDEGSSVEMEQKTPEKTLAAQKREKLQKLKELSKQRSRQRRSSGRDFE

SEQ ID NO: 18740 - protein, 444 aa, Homo sapiens
  Payload ID: 3760
  Gene Symbol: CCDC83
  Gene Name: coiled-coil domain containing 83
  Uniprot ID: Q8IWF9
  ENSP ID: ENSP00000280245
MENSGKANKKDTHDGPPKEIKLPTSEALLDYQCQIKEDAVEQFMFQIKTLRKKNQKYHERNSRLKEEQIWHIRHLLKELSEEKAEGLPVVTREDVEEAMKEKWKFERDQEKNLRDMRMQISNAEKLFLEKLSEKEYWEEYKNVGSERHAKLITSLQNDINTVKENAEKMSEHYKITLEDTRKKIIKETLLQLDQKKEWATQNAVKLIDKGSYLEIWENDWLKKEVAIHRKEVEELKNAIHELEAENLVLIDQLSNCRLVDLKIPRYPVLHSCPTSNPRHLLLLPLESCLISARRCWRLYLTQAAGLEVPPEEMSLELPETHIEEKSELQPTEVESRDLMSSSDESTILHLSHENSIEDLQYVKIDKEENSGTEFGDTDMKYLLYEDEKDFKDYVNLGPLGVKLMSVESKKMPIHFQEKEIPVKLYKDVRSPESHITYKMMKSFL

SEQ ID NO: 18741 - protein, 413 aa, Homo sapiens
  Payload ID: 3760
  Gene Symbol: CCDC83
  Gene Name: coiled-coil domain containing 83
  Uniprot ID: Q8IWF9
  ENSP ID: ENSP00000344512
MENSGKANKKDTHDGPPKEIKLPTSEALLDYQCQIKEDAVEQFMFQIKTLRKKNQKYHERNSRLKEEQIWHIRHLLKELSEEKAEGLPVVTREDVEEAMKEKWKFERDQEKNLRDMRMQISNAEKLFLEKLSEKEYWEEYKNVGSERHAKLITSLQNDINTVKENAEKMSEHYKITLEDTRKKIIKETLLQLDQKKEWATQNAVKLIDKGSYLEIWENDWLKKEVAIHRKEVEELKNAIHELEAENLVLIDQLSNCRLVDLKIPRRLYLTQAAGLEVPPEEMSLELPETHIEEKSELQPTEVESRDLMSSSDESTILHLSHENSIEDLQYVKIDKEENSGTEFGDTDMKYLLYEDEKDFKDYVNLGPLGVKLMSVESKKMPIHFQEKEIPVKLYKDVRSPESHITYKMMKSFL

SEQ ID NO: 18742 - protein, 318 aa, Homo sapiens
  Payload ID: 3760
  Gene Symbol: CCDC83
  Gene Name: coiled-coil domain containing 83
  ENSP ID: ENSP00000434373
  MOD_RES (1)..(1): Any amino acid
XVEQFMFQIKTLRKKNQKYHERNSRLKEEQIWHIRHLLKELSEEKAEGLPVVTREDVEEAMKEKWKFERDQEKNLREHYKITLEDTRKKIIKETLLQLDQKKEWATQNAVKLIDKGSYLEIWENDWLKKEVAIHRKEVEELKNAIHELEAENLVLIDQLSNCRLVDLKIPRRLYLTQAAGLEVPPEEMSLELPETHIEKSELQPTEVESRDLMSSSDESTILHLSHENSIEDLQYVKIDKEENSGTEFGDTDMKYLLYEDEKDFKDYVNLGPLGVKLMSVESKKMPIHFQEKEIPVKLYKDVRSPESHITYKMMKSFL

SEQ ID NO: 18743 - protein, 332 aa, Homo sapiens
  Payload ID: 3761
  Gene Symbol: CCDC84
  Gene Name: coiled-coil domain containing 84
  Uniprot ID: Q86UT8
  ENSP ID: ENSP00000334767
MAPAQRCPLCRQTFFCGRGHVYSRKHQRQLKEALERLLPQVEAARKAIRAAQVERYVPEHERCCWCLCCGCEVREHLSHGNLTVLYGGLLEHLASPEHKKATNKFWWENKAEVQMKEKFLVTPQDYARFKKSMVKGLDSYEEKEDKVIKEMAAQIREVEQSRQEVVRSVLEPQAVPDPEEGSSAPRSWKGMNSQVASSLQQPSNLDLPPAPELDWMETGPSLTFIGHQDIPGVGNIHSGATPPWMIQDEEYIAGNQEIGPSYEEFLKEKEKQKLKKLPPDRVGANFDHSSRTSAGWLPSFGRVWNNGRRWQSRHQFKTEAAAMKKQSHTEKS

SEQ ID NO: 18744 - protein, 194 aa, Homo sapiens
  Payload ID: 3761
  Gene Symbol: CCDC84
  Gene Name: coiled-coil domain containing 84
  ENSP ID: ENSP00000431889
MAPAQRCPLCRQTFFCGRGHVYSRKHQRQLKEALERLLPQVEAARKAIRAAQVERYVPEHERCCWCLCCGCEVREHLSHGNLTVLYGGLLEHLASPEHKKATNKFWWENKAEVQMKEKFLVTPQDYARFKKSMVKGLDSYEEKEDKVIKEMAAQIREVEQSRQEVVRSVLEVGFPRRIQTTSGSARPRRGLFST

SEQ ID NO: 18745 - protein, 148 aa, Homo sapiens
  Payload ID: 3761
  Gene Symbol: CCDC84
  Gene Name: coiled-coil domain containing 84
  ENSP ID: ENSP00000436340
MAPAQRCPLCRQTFFCGRGHVYSRKHQRQLKEALERLLPQVEAARKAIRAAQVERYVPEHERCCWCLCCGCEVREHLSHGNLTVLYGGLLEHLASPEHKKATNKFWWENKAEVQMKEKFLVTPQDYARLCGSSASFFKLLQISKKIFK

SEQ ID NO: 18746 - protein, 194 aa, Homo sapiens; identical to SEQ ID NO: 18744
  Payload ID: 3761
  Gene Symbol: CCDC84
  Gene Name: coiled-coil domain containing 84
  ENSP ID: ENSP00000486513

SEQ ID NO: 18747 - protein, 148 aa, Homo sapiens; identical to SEQ ID NO: 18745
  Payload ID: 3761
  Gene Symbol: CCDC84
  Gene Name: coiled-coil domain containing 84
  ENSP ID: ENSP00000486537

SEQ ID NO: 18748 - protein, 332 aa, Homo sapiens; identical to SEQ ID NO: 18743
  Payload ID: 3761
  Gene Symbol: CCDC84
  Gene Name: coiled-coil domain containing 84
  Uniprot ID: Q86UT8
  ENSP ID: ENSP00000487197

SEQ ID NO: 18749 - protein, 553 aa, Homo sapiens
  Payload ID: 3762
  Gene Symbol: CCDC85A
  Gene Name: coiled-coil domain containing 85A
  Uniprot ID: Q96PX6
  ENSP ID: ENSP00000384040
MSKAAGGAAAAAAAAESCSPAPAGSSAAPPAPVEDLSKVSDEELLQWSKEELIRSLRRAEAEKVSAMLDHSNLIREVNRRLQLHLGEIRGLKDINQKLQEDNQELRDLCCFLDDDRQKGKRVSREWQRLGRYTAGVMHKEVALYLQKLKDLEVKQEEVVKENMELKELCVLLDEEKGAGCAGSRCSIDSQASLCQLTASTAPYVRDVGDGSSTSSTGSTDSPDHHKHHASSGSPEHLQKPRSEGSPEHSKHRSASPEHPQKPRACGTPDRPKALKGPSPEHHKPLCKGSPEQQRHPHPGSSPETLPKHVLSGSPEHFQKHRSGSSPEHARHSGGSPEHLQKHALGGSLEHLPRARGTSPEHLKQHYGGSPDHKHGGGSGGSGGSGGGSREGTLRRQAQEDGSPHHRNVYSGMNESTLSYVRQLEARVRQLEEENRMLPQASQNRRQPPTRNSSNMEKGWGSRARRVLQWWQGCRGIGRCLPTLPGSFRLSSGADGSNSSPNSAASFSGHATPSQQPEPVVHSLKVVWRKLGDAAGSCPGIRQHLSGNQYKGPM

SEQ ID NO: 18750 - protein, 202 aa, Homo sapiens
  Payload ID: 3763
  Gene Symbol: CCDC85B
  Gene Name: coiled-coil domain containing 85B
  Uniprot ID: Q15834
  ENSP ID: ENSP00000311695
MEAEAGGLEELTDEEMAALGKEELVRRLRREEAARLAALVQRGRLMQEVNRQLQGHLGEIRELKQLNRRLQAENRELRDLCCFLDSERQRGRRAARQWQLFGTQASRAVREDLGGCWQKLAELEGRQEELLRENLALKELCLALGEEWGPRGGPSGAGGSGAGPAPELALPPCGPRDLGDGSSSTGSVGSPDQLPLACSPDD

SEQ ID NO: 18751 - protein, 419 aa, Homo sapiens
  Payload ID: 3764
  Gene Symbol: CCDC85C
  Gene Name: coiled-coil domain containing 85C
  Uniprot ID: A6NKD9
  ENSP ID: ENSP00000369592
MAKPAATAAAASEELSQVPDEELLRWSKEELARRLRRAEGEKVGLMLEHGGLMRDVNRRLQQHLLEIRGLKDVNQRLQDDNQELRELCCFLDDDRQKGRKLAREWQRFGRHAAGAVWHEVARSQQKLRELEARQEALLRENLELKELVLLLDEERAALAATGAASGGGGGGGGAGSRSSIDSQASLSGPLSGGAPGAGARDVGDGSSTSSAGSGGSPDHHHHVPPPLLPPGPHKAPDGKAGATRRSLDDLSAPPHHRSIPNGLHDPSSTYIRQLESKVRLLEGDKLLAQQAGSGEFRTLRKGFSPYHSESQLASLPPSYQDSLQNGPACPAPELPSPPSAGYSPAGQKPEAVVHAMKVLEVHENLDRQLQDSCEEDLSEKEKAIVREMCNVVWRKLGDAASSKPSIRQHLSGNQFKGPL

SEQ ID NO: 18752 - protein, 64 aa, Homo sapiens
  Payload ID: 3764
  Gene Symbol: CCDC85C
  Gene Name: coiled-coil domain containing 85C
  ENSP ID: ENSP00000450602
MKVLEVHENLDRQLQDSCEEDLSEKEKAIVREMCNVVWRKLGDAASSKPSIRQHLSGNQFKGPL

SEQ ID NO: 18753 - protein, 64 aa, Homo sapiens; identical to SEQ ID NO: 18752
  Payload ID: 3764
  Gene Symbol: CCDC85C
  Gene Name: coiled-coil domain containing 85C
  ENSP ID: ENSP00000450850

SEQ ID NO: 18754 - protein, 190 aa, Homo sapiens
  Payload ID: 3764
  Gene Symbol: CCDC85C
  Gene Name: coiled-coil domain containing 85C
  ENSP ID: ENSP00000451294
SSSSHFADRIPGRCLLFRNVRPRGRGQPCPCDSLRDPSSTYIRQLESKVRLLEGDKLLAQQAGSGEFRTLRKGFSPYHSESQLASLPPSYQDSLQNGPACPAPELPSPPSAGYSPAGQKPEAVVHAMKVLEVHENLDRQLQDSCEEDLSEKEKAIVREMCNVVWRKLGDAASSKPSIRQHLSGNQFKGPL

SEQ ID NO: 18755 - protein, 116 aa, Homo sapiens
  Payload ID: 3764
  Gene Symbol: CCDC85C
  Gene Name: coiled-coil domain containing 85C
  ENSP ID: ENSP00000451718
MDKLANKSMDGTVSYPDPSSTYIRQLESKVRLLEGDKLLAQQAGSGEFRTLRKGFSPYHSESQLASLPPSYQDSLQNGPACPAPELPSPPSAGYSPAGQKPEAVVHAMKVLEVHEN

SEQ ID NO: 18756 - protein, 47 aa, Homo sapiens
  Payload ID: 3764
  Gene Symbol: CCDC85C
  Gene Name: coiled-coil domain containing 85C
  ENSP ID: ENSP00000452300
MKVLEVHENLDRQLQDSCEEDLSEKEKAIVREMCNVVWRKLGDAASS

SEQ ID NO: 18757 - protein, 123 aa, Homo sapiens
  Payload ID: 3764
  Gene Symbol: CCDC85C
  Gene Name: coiled-coil domain containing 85C
  ENSP ID: ENSP00000452496
  MOD_RES (1)..(1): Any amino acid
XPSSTYIRQLESKVRLLEGDKLLAQQAGSGEFRTLRKGFSPYHSESQLASLPPSYQDSLQNVLEVHENLDRQLQDSCEEDLSEKEKAIVREMCNVVWRKLGDAASSKPSIRQHLSGNQFKGPL

SEQ ID NO: 18758 - protein, 360 aa, Homo sapiens
  Payload ID: 3765
  Gene Symbol: CCDC86
  Gene Name: coiled-coil domain containing 86
  Uniprot ID: Q9H6F5
  ENSP ID: ENSP00000227520
MDTPLRRSRRLGGLRPESPESLTSVSRTRRALVEFESNPEETREPGSPPSVQRAGLGSPERPPKTSPGSPRLQQGAGLESPQGQPEPGAASPQRQQDLHLESPQRQPEYSPESPRCQPKPSEEAPKCSQDQGVLASELAQNKEELTPGAPQHQLPPVPGSPEPYPGQQAPGPEPSQPLLELTPRAPGSPRGQHEPSKPPPAGETVTGGFGAKKRKGSSSQAPASKKLNKEELPVIPKGKPKSGRVWKDRSKKRFSQMLQDKPLRTSWQRKMKERQERKLAKDFARHLEEEKERRRQEKKQRRAENLKRRLENERKAEVVQVIRNPAKLKRAKKKQLRSIEKRDTLALLQKQPPQQPAAKI

SEQ ID NO: 18759 - protein, 104 aa, Homo sapiens
  Payload ID: 3765
  Gene Symbol: CCDC86
  Gene Name: coiled-coil domain containing 86
  Uniprot ID: Q9H6F5
  ENSP ID: ENSP00000440906
MLQDKPLRTSWQRKMKERQERKLAKDFARHLEEEKERRRQEKKQRRAENLKRRLENERKAEVVQVIRNPAKLKRAKKKQLRSIEKRDTLALLQKQPPQQPAAKI

SEQ ID NO: 18760 - protein, 88 aa, Homo sapiens
  Payload ID: 3765
  Gene Symbol: CCDC86
  Gene Name: coiled-coil domain containing 86
  ENSP ID: ENSP00000442111
  MOD_RES (1)..(1): Any amino acid
XSRRLGGLRPESPESLTSVSRTRRALVEFESNPEETREPGSPPSVQRAGLGSPERPPKTSPGSPRLQQGAGLESPQGQPEPGAASPQP

SEQ ID NO: 18761 - protein, 849 aa, Homo sapiens
  Payload ID: 3766
  Gene Symbol: CCDC87
  Gene Name: coiled-coil domain containing 87
  Uniprot ID: Q9NVE4
  ENSP ID: ENSP00000328487
MMEPPKPEPELQRFYHRLLRPLSLFPTRTTSPEPQKRPPQEGRILQSFPLAKLTVASLCSQVAKLLAGSGIAAGVPPEARLRLIKVILDELKCSWREPPAELSLSHKNNQKLRKRLEAYVLLSSEQLFLRYLHLLVTMSTPRGVFTESATLTRLAASLARDCTLFLTSPNVYRGLLADFQALLRAEQASGDVDKLHPVCPAGTFKLCPIPWPHSTGFAQVQCSNLNLNYLIQLSRPPEFLNEPGRMDPVKELKSIPRLKRKKPFHWLPSIGKKREIDISSSQMVSLPSYPVAPTSRASPSPFCPELRRGQSMPSLREGWRLADELGLPPLPSRPLTPLVLATESKPELTGLIVAEDLKQLIKKMKLEGTRYPPLDSGLPPLLGVVTRHPAAGHRLEELEKMLRNLQEEEASGQWDPQPPKSFPLHPQPVTITLKLRNEVVVQAAAVRVSDRNFLDSFHIEGAGALYNHLAGELDPKAIEKMDIDNFVGSTTREVYKELMSHVSSDHLHFDQGPLVEPAADKDWSTFLSSAFLRQEKQPQIINPELVGLYSQRANTLQSNTKKMPSLPSLQATKSWEKWSNKASLMNSWKTTLSVDDYFKYLTNHETDFLHVIFQMHEEEVPVEIVAPARESLEIQHPPPLLEDEEPDFVPGEWDWNTVLEHRLGAGKTPHLGEPHKILSLQKHLEQLWSVLEVPDKDQVDMTIKYSSKARLRQLPSLVNAWERALKPIQLREALLARLEWFEGQASNPNRFFKKTNLSSSHFLEENQVRSHLHRKLNLMESSLVSLLEEIELIFGEPVIFKGRPYLDKMKSDKVEMLYWLQQQRRVRHLVSALKDPHQSTLFRSSAASL

SEQ ID NO: 18762 - protein, 1843 aa, Homo sapiens
  Payload ID: 3767
  Gene Symbol: CCDC88A
  Gene Name: coiled-coil domain containing 88A
  Uniprot ID: Q3V6T2
  ENSP ID: ENSP00000263630
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSTMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 18763 - protein, 1870 aa, Homo sapiens
  Payload ID: 3767
  Gene Symbol: CCDC88A
  Gene Name: coiled-coil domain containing 88A
  Uniprot ID: Q3V6T2
  ENSP ID: ENSP00000338728
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 18764 - protein, 888 aa, Homo sapiens
  Payload ID: 3767
  Gene Symbol: CCDC88A
  Gene Name: coiled-coil domain containing 88A
  ENSP ID: ENSP00000390012
LLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSTMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 18765 - protein, 147 aa, Homo sapiens
  Payload ID: 3767
  Gene Symbol: CCDC88A
  Gene Name: coiled-coil domain containing 88A
  ENSP ID: ENSP00000399237
MHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLH

SEQ ID NO: 18766 - protein, 1796 aa, Homo sapiens
  Payload ID: 3767
  Gene Symbol: CCDC88A
  Gene Name: coiled-coil domain containing 88A
  Uniprot ID: Q3V6T2
  ENSP ID: ENSP00000404431
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLASVISTAEGTTRRTSIHDFLTKDSRLPISVDSPPAAADSNTTAASNVDKVQESRNSKSRSREQQSS

SEQ ID NO: 18767 - protein, 1202 aa, Homo sapiens
  Payload ID: 3767
  Gene Symbol: CCDC88A
  Gene Name: coiled-coil domain containing 88A
  ENSP ID: ENSP00000405080
QLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASSEYHLHQWSSHILDIPTHTIGSCAQNDLAIDMPEPLYAQARNSRTGRSHFLNQTFATIRMPSDAFGMLAKDSIGPFTVAHSSQPFLSLNTELVSNISGLPPRPVIRITDQASASLDKPAQKENEQFSDHQNPSNSNLQFSINSNNLVTSACLYPDDTEAALLVSEDNQTVWYEYGCI

SEQ ID NO: 18768 - protein, 1871 aa, Homo sapiens
  Payload ID: 3767
  Gene Symbol: CCDC88A
  Gene Name: coiled-coil domain containing 88A
  Uniprot ID: Q3V6T2
  ENSP ID: ENSP00000410608
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 18769 - protein, 374 aa, Homo sapiens
  Payload ID: 3767
  Gene Symbol: CCDC88A
  Gene Name: coiled-coil domain containing 88A
  ENSP ID: ENSP00000413401
  MOD_RES (1)..(1): Any amino acid
XIMDQYKFYDPSPPRRRGNWITLKMRKLIKSKKDINRERQKSLTLTPTRSDSSEGFLQLPHQDSQDSSSVGSNSLEDGQTLGTKKSSNTTSFEDISPQGVSDDSSTGSRVHAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 18770 - protein, 736 aa, Homo sapiens
  Payload ID: 3767
  Gene Symbol: CCDC88A
  Gene Name: coiled-coil domain containing 88A
  ENSP ID: ENSP00000415267
  MOD_RES (1)..(1): Any amino acid
XKKSLEIKEEKIAALEARLEESTNYNQQLRQELKTNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSTMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKL

SEQ ID NO: 18771 - protein, 741 aa, Homo sapiens [sequence omitted]

SEQ ID NO: 18772 - protein, 139 aa, Homo sapiens
  Payload ID: 3768
  Gene Symbol: CCDC88B
  Gene Name: coiled-coil domain containing 88B
  Uniprot ID: A6NC98
  ENSP ID: ENSP00000301897
MPCAARSRSSWRRSWTNTACWSLCPCPGPRSPSPAPMRRAQSSLCLRDETLAGGQRRKLSSRFPVGRSSESFSPGDTPRQRFRQRHPGPLGAPVSHSKGPGVGWENSAETLQEHETDANREGPEVQEPEKRPLTPSLSQ

SEQ ID NO: 18773 - protein, 1476 aa, Homo sapiens
  Payload ID: 3768
  Gene Symbol: CCDC88B
  Gene Name: coiled-coil domain containing 88B
  Uniprot ID: A6NC98
  ENSP ID: ENSP00000349238
MEGGKGPRLRDFLSGSLATWALGLAGLVGEAEDSEGEEEEEEEEPPLWLEKRFLRLSDGALLLRVLGIIAPSSRGGPRMLRGLDGPAAWRVWNLNHLWGRLRDFYQEELQLLILSPPPDLQTLGFDPLSEEAVEQLEGVLRLLLGASVQCEHRELFIRHIQGLSLEVQSELAAAIQEVTQPGAGVVLALSGPDPGELAPAELEMLSRSLMGTLSKLARERDLGAQRLAELLLEREPLCLRPEAPSRAPAEGPSHHLALQLANAKAQLRRLRQELEEKAELLLDSQAEVQGLEAEIRRLRQEAQALSGQAKRAELYREEAEALRERAGRLPRLQEELRRCRERLQAAEAYKSQLEEERVLSGVLEASKALLEEQLEAARERCARLHETQRENLLLRTRLGEAHAELDSLRHQVDQLAEENVELELELQRSLEPPPGSPGEAPLAGAAPSLQDEVREAEAGRLRTLERENRELRGLLQVLQGQPGGQHPLLEAPREDPVLPVLEEAPQTPVAFDHSPQGLVQKARDGGPQALDLAPPALDSVLEASAECPQAPDSDPQEAESPLQAAAMDPQASDWSPQESGSPVETQESPEKAGRRSSLQSPASVAPPQGPGTKIQAPQLLGGETEGREAPQGELVPEAWGLRQEGPEHKPGPSEPSSVQLEEQEGPNQGLDLATGQAEAREHDQRLEGTVRDPAWQKPQQKSEGALEVQVWEGPIPGESLASGVAEQEALREEVAQLRRKAEALGDELEAQARKLEAQNTEAARLSKELAQARRAEAEAHREAEAQAWEQARLREAVEAAGQELESASQEREALVEALAAAGRERRQWEREGSRLRAQSEAAEERMQVLESEGRQHLEEAERERREKEALQAELEKAVVRGKELGDRLEHLQRELEQAALERQEFLREKESQHQRYQGLEQRLEAELQAAATSKEEALMELKTRALQLEEELFQLRQGPAGLGPKKRAEPQLVETQNVRLIEVERSNAMLVAEKAALQGQLQHLEGQLGSLQGRAQELLLQSQRAQEHSSRLQAEKSVLEIQGQELHRKLEVLEEEVRAARQSQEETRGQQQALLRDHKALAQLQRRQEAELEGLLVRHRDLKANMRALELAHRELQGRHEQLQAQRASVEAQEVALLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKKGSWLADKVKRLMRPRREGGPPGGLRLGADGAGSTESLGGPPETELPEGREADGTGSPSPAPMRRAQSSLCLRDETLAGGQRRKLSSRFPVGRSSESFSPGDTPRQRFRQRHPGPLGAPVSHSKGPGVGWENSAETLQEHETDANREGPEVQEPEKRPLTPSLSQ

SEQ ID NO: 18774 - protein, 712 aa, Homo sapiens
  Payload ID: 3768
  Gene Symbol: CCDC88B
  Gene Name: coiled-coil domain containing 88B
  ENSP ID: ENSP00000352974
MAGVAAHRAHPPFTAHMKNRGLREELEKAVVRGKELGDRLEHLQRELEQAALERQEFLREKESQHQRYQGLEQRLEAELQAAATSKEEALMELKTRALQLEEELFQLRQGPAGLGPKKRAEPQLVETQNVRLIEVERSNAMLVAEKAALQGQLQHLEGQLGSLQGRAQELLLQSQRAQEHSSRLQAEKSVLEIQGQELHRKLEVLEEEVRAARQSQEETRGQQQALLRDHKALAQLQRRQEAELEGLLVRHRDLKANMRALELAHRELQGRHEQLQAQRASVEAQEVALLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKKGSWLADKGPLPRHPCAGPRAPSACGMRPWQAGSGGNSAQGSRWGEALSHSALGTPLGNDSDSAIQAPWGRPSPTAKDLVWDGRTPLRPCRNTKQMPTERALRYRNRRNVPSPHPSASDTVGTAGLGVQPSRHWSVSGGPRQPKSSGSQGPQGESLDKEAWALRSSTVSAGARRWSWDECVDRGDGWPPRAAPGWSSGSSRWLPLRQRSLGDPPAEGGWQELAREPPALSRWEAESQCWGTVAWADLEP

SEQ ID NO: 18775 - protein, 506 aa, Homo sapiens
  Payload ID: 3769
  Gene Symbol: CCDC88C
  Gene Name: coiled-coil domain containing 88C
  ENSP ID: ENSP00000330332
MSVLSPGDLKPKRGSPHRGSLDRTDASTDLAMRSWPSELGSRTCSTSATTTAPSNSTPIARHPGRTKGYNSDDNLCEPSLEFEVPNHRQYVSRPSSLESSRNTSSNSSPLNLKGSSEQLHGRSESFSSEDLIPSRDLATLPREASTPGRNALGRHEYPLPRNGPLPQEGAQKRGTAPPYVGVRPCSASPSSEMVTLEEFLEESNRSSPTHDTPSCRDDLLSDYFRKASDPPAIGGQPGPPAKKEGAKMPTNFVAPTVKMAAPTSEGRPLKPGQYVKPNFRLTEAEAPPSVAPRQAQPPQSLSLGRPRQAPEALGGRETGSHTLQSPAPPSSHSLARERTPLVGKAGSSCQGPGPRSRPLDTRRFSLAPPKEERLAPLHQSATAPAIATAGAGAAAAGSGSNSQLLHFSPAAAPAARTKPKAPPRSGEVATITPVRAGLSLSEGDGVPGQGCSEGLPAKSPGRSPDLAPHLGRALEDCSRGSVSKSSPASPEPGGDPQTVWYEYGCV

SEQ ID NO: 18776 - protein, 88 aa, Homo sapiens
  Payload ID: 3769
  Gene Symbol: CCDC88C
  Gene Name: coiled-coil domain containing 88C
  ENSP ID: ENSP00000374506
MGGAEWESEQTGVKTFGPFGSGSQDNLTMYMDLVDGIFLNQIMLQIDPRPTNQRINKHVNNDVNLRIQNLTILVRNIKTYYQDRPFFR

SEQ ID NO: 18777 - protein, 2028 aa, Homo sapiens
  Payload ID: 3769
  Gene Symbol: CCDC88C
  Gene Name: coiled-coil domain containing 88C
  Uniprot ID: Q9P219
  ENSP ID: ENSP00000374507
MDVTVSELLELFLQSPLVTWVKTFGPFGSGSQDNLTMYMDLVDGIFLNQIMLQIDPRPTNQRINKHVNNDVNLRIQNLTILVRNIKTYYQEVLQQLIVMNLPNVLMIGRDPLSGKSMEEIKKVLLLVLGCAVQCERKEEFIERIKQLDIETQAGIVAHIQEVTHNQENVFDLQWLELPDVAPEELEALSRSMVLHLRRLIDQRDECTELIVDLTQERDYLQAQHPPSPIKSSSADSTPSPTSSLSSEDKQHLAVELADTKARLRRVRQELEDKTEQLVDTRHEVDQLVLELQKVKQENIQLAADARSARAYRDELDSLREKANRVERLELELTRCKEKLHDVDFYKARMEELREDNIILIETKAMLEEQLTAARARGDKVHELEKENLQLKSKLHDLELDRDTDKKRIEELLEENMVLEIAQKQSMNESAHLGWELEQLSKNADLSDASRKSFVFELNECASSRILKLEKENQSLQSTIQGLRDASLVLEESGLKCGELEKENHQLSKKIEKLQTQLEREKQSNQDLETLSEELIREKEQLQSDMETLKADKARQIKDLEQEKDHLNRAMWSLRERSQVSSEARMKDVEKENKALHQTVTEANGKLSQLEFEKRQLHRDLEQAKEKGERAEKLERELQRLQEENGRLARKVTSLETATEKVEALEHESQGLQLENRTLRKSLDTLQNVSLQLEGLERDNKQLDAENLELRRLVETMRFTSTKLAQMERENQQLEREKEELRKNVDLLKALGKKSERLELSYQSVSAENLRLQQSLESSSHKTQTLESELGELEAERQALRRDLEALRLANAQLEGAEKDRKALEQEVAQLEKDKKLLEKEAKRLWQQVELKDAVLDDSTAKLSAVEKESRALDKELARCRDAAGKLKELEKDNRDLTKQVTVHARTLTTLREDLVLEKLKSQQLSSELDKLSQELEKVGLNRELLLQEDDSGSDTKYKILEGRNESALKTTLAMKEEKIVLLEAQMEEKASLNRQLESELQMLKKECETLRQNQGEGQHLQNSFKHPAGKTAASHQGKEAWGPGHKEATMELLRVKDRAIELERNNAALQAEKQLLKEQLQHLETQNVTFSSQILTLQKQSAFLQEHNTTLQTQTAKLQVENSTLSSQSAALTAQYTLLQNHHTAKETENESLQRQQEQLTAAYEALLQDHEHLGTLHERQSAEYEALIRQHSCLKTLHRNLELEHKELGERHGDMLKRKAELEEREKVLTTEREALQQEQRTNALAMGENQRLRGELDRVNFLHHQLKGEYEELHAHTKELKTSLNNAQLELNRWQARFDELKEQHQTMDISLTKLDNHCELLSRLKGNLEEENHHLLSQIQLLSQQNQMLLEQNMENKEQYHEEQKQYIDKLNALRRHKEKLEEKIMDQYKFYDPPPKKKNHWIGAKALVKLIKPKKEGSRERLKSTVDSPPWQLESSDPASPAASQPLRSQAENPDTPALGSNCAEERDAHNGSVGKGPGDLKPKRGSPHRGSLDRTDASTDLAMRSWPSELGSRTCSTSATTTAPSNSTPIARHPGRTKGYNSDDNLCEPSLEFEVPNHRQYVSRPSSLESSRNTSSNSSPLNLKGSSEQLHGRSESFSSEDLIPSRDLATLPREASTPGRNALGRHEYPLPRNGPLPQEGAQKRGTAPPYVGVRPCSASPSSEMVTLEEFLEESNRSSPTHDTPSCRDDLLSDYFRKASDPPAIGGQPGPPAKKEGAKMPTNFVAPTVKMAAPTSEGRPLKPGQYVKPNFRLTEAEAPPSVAPRQAQPPQSLSLGRPRQAPVPPASHAPASRSASLSRAFSLASADLLRASGPEACKQESPQKLGAPEALGGRETGSHTLQSPAPPSSHSLARERTPLVGKAGSSCQGPGPRSRPLDTRRFSLAPPKEERLAPLHQSATAPAIATAGAGAAAAGSGSNSQLLHFSPAAAPAARTKPKAPPRSGEVATITPVRAGLSLSEGDGVPGQGCSEGLPAKSPGRSPDLAPHLGRALEDCSRGSVSKSSPASPEPGGDPQTVWYEYGCV

SEQ ID NO: 18778 - protein, 96 aa, Homo sapiens
  Payload ID: 3769
  Gene Symbol: CCDC88C
  Gene Name: coiled-coil domain containing 88C
  ENSP ID: ENSP00000451392
MDVTVSELLELFLQSPLVTWVKTFGPFGSGSQDNLTMYMDLVDGIFLNQIMLQIDPRPTNQRINKHVNNDVNLRIQNLTILVRNIKTYYQDRPFFR

SEQ ID NO: 18779 - protein, 131 aa, Homo sapiens
  Payload ID: 3769
  Gene Symbol: CCDC88C
  Gene Name: coiled-coil domain containing 88C
  ENSP ID: ENSP00000452406
  MOD_RES (1)..(1): Any amino acid
XIGAKALVKLIKPKKEGSRERLKSTVDSPPWQLESSDPASPAASQPLRSQAENPDTPALGSNCAEERDAHNGSVGKAPPRKKSPFLKSKNKDKDKSPTTHPALSKRLRFWSSSDIPSSPNEPLSFSDIGDF

SEQ ID NO: 18780 - protein, 374 aa, Homo sapiens
  Payload ID: 3770
  Gene Symbol: CCDC89
  Gene Name: coiled-coil domain containing 89
  Uniprot ID: Q8N998
  ENSP ID: ENSP00000320649
MRAPMLQKQQAPRMDTPPPEERLEKQNEKLNNQEEETEFKELDGLREALANLRGLSEEERSEKAMLRSRIEEQSQLICILKRRSDEALERCQILELLNAELEEKMMQEAEKLKAQGEYSRKLEERFMTLAANHELMLRFKDEYKSENIKLREENEKLRLENSSLFSQALKDEEAKVLQLTVRCEALTGELETLKERCAQDACQAQAREKELLELQSQQACTHTKETEQLRSQLQTLKQQHQQAVEQIAKAEETHSSLSQELQARLQTVTREKEELLQLSIERGKVLQNKQAEICQLEEKLEIANEDRKHALERFEQEAVAVDSNLRVRELQRKVDGIQKAYDELRLQSEAFKKHSLDLLSKERELNGKLRHLSP

SEQ ID NO: 18781 - protein, 531 aa, Homo sapiens
  Payload ID: 3771
  Gene Symbol: CCDC9
  Gene Name: coiled-coil domain containing 9
  Uniprot ID: Q9Y3X0
  ENSP ID: ENSP00000221922
MAATLDLKSKEEKDAELDKRIEALRRKNEALIRRYQEIEEDRKKAELEGVAVTAPRKGRSVEKENVAVESEKNLGPSRRSPGTPRPPGASKGGRTPPQQGGRAGMGRASRSWEGSPGEQPRGGGAGGRGRRGRGRGSPHLSGAGDTSISDRKSKEWEERRRQNIEKMNEEMEKIAEYERNQREGVLEPNPVRNFLDDPRRRSGPLEESERDRREESRRHGRNWGGPDFERVRCGLEHERQGRRAGLGSAGDMTLSMTGRERSEYLRWKQEREKIDQERLQRHRKPTGQWRREWDAEKTDGMFKDGPVPAHEPSHRYDDQAWARPPKPPTFGEFLSQHKAEASSRRRRKSSRPQAKAAPRAYSDHDDRWETKEGAASPAPETPQPTSPETSPKETPMQPPEIPAPAHRPPEDEGEENEGEEDEEWEDISEDEEEEEIEVEEGDEEEPAQDHQAPEAAPTGIPCSEQAHGVPFSPEEPLLEPQAPGTPSSPFSPPSGHQPVSDWGEEVELNSPRTTHLAGALSPGEAWPFESV

SEQ ID NO: 18782 - protein, 128 aa, Homo sapiens
  Payload ID: 3771
  Gene Symbol: CCDC9
  Gene Name: coiled-coil domain containing 9
  ENSP ID: ENSP00000469717
MAATLDLKSKEEKDAELDKRIEALRRKNEALIRRYQEIEEDRKKAELEGVAVTAPRKGRSVEKENVAVESEKNLGPSRRSPGTPRPPGASKGGRTPPQQGGRAGMGRASRSWEGSPGEQPRGGGAGGR

SEQ ID NO: 18783 - protein, 56 aa, Homo sapiens
  Payload ID: 3771
  Gene Symbol: CCDC9
  Gene Name: coiled-coil domain containing 9
  ENSP ID: ENSP00000470706
MAATLDLKSKEEKDAELDKRIEALRRKNEALIRRYQEIEEDRKKAELEGVAVTAPR

SEQ ID NO: 18784 - protein, 48 aa, Homo sapiens
  Payload ID: 3771
  Gene Symbol: CCDC9
  Gene Name: coiled-coil domain containing 9
  ENSP ID: ENSP00000472843
MAATLDLKSKEEKDAELDKRIEALRRKNEALIRRYQEIEEDRKKAELE

SEQ ID NO: 18785 - protein, 162 aa, Homo sapiens
  Payload ID: 3772
  Gene Symbol: CCDC90B
  Gene Name: coiled-coil domain containing 90B
  ENSP ID: ENSP00000260054
MNSRQAWRLFLSQGRGDRWVSRPRGHFSPALRREFFTTTTKEGYDRRPVDITPLEQRKLTFDTHALVQDLETHGFDKTQAETIVSALTALSNVSLDTIYKEMVTQAQQEITVQQLMAHLDAIRKDMVILEKSEFANLRAENEKMKIELDQVKQQLMVSEFFF

SEQ ID NO: 18786 - protein, 245 aa, Homo sapiens
  Payload ID: 3772
  Gene Symbol: CCDC90B
  Gene Name: coiled-coil domain containing 90B
  Uniprot ID: Q9GZT6
  ENSP ID: ENSP00000390990
MLANCGSVCEETQFRGTTVAPALGEFFTTTTKEGYDRRPVDITPLEQRKLTFDTHALVQDLETHGFDKTQAETIVSALTALSNVSLDTIYKEMVTQAQQEITVQQLMAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 18787 - protein, 153 aa, Homo sapiens
  Payload ID: 3772
  Gene Symbol: CCDC90B
  Gene Name: coiled-coil domain containing 90B
  Uniprot ID: Q9GZT6
  ENSP ID: ENSP00000431345
MVTQAQQEITVQQLMAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 18788 - protein, 153 aa, Homo sapiens; identical to SEQ ID NO: 18787
  Payload ID: 3772
  Gene Symbol: CCDC90B
  Gene Name: coiled-coil domain containing 90B
  Uniprot ID: Q9GZT6
  ENSP ID: ENSP00000431424

SEQ ID NO: 18789 - protein, 208 aa, Homo sapiens
  Payload ID: 3772
  Gene Symbol: CCDC90B
  Gene Name: coiled-coil domain containing 90B
  ENSP ID: ENSP00000431523
MNSRQAWRLFLSQGRGDRWVSRPRGHFSPALRREFFTTTTKEGYDRRPVDITPLEQRKLTFDTHALVQDLETHGFDKTQAETIVSALTALSNVSLDTIYKEMVTQAQQEITVQQLMAHLDAIRKDMVILEKSEFANLRAENEKMKIELDQVKQQLMTFFLTSCCFISYSLQIKKSNLWKQLQNLQKRILKPKVLFQRPVIKLTLKLLP

SEQ ID NO: 18790 - protein, 38 aa, Homo sapiens
  Payload ID: 3772
  Gene Symbol: CCDC90B
  Gene Name: coiled-coil domain containing 90B
  ENSP ID: ENSP00000432115
MNSRQAWRLFLSQGRGDRWVSRPRGHFSPALRRVFKPF

SEQ ID NO: 18791 - protein, 117 aa, Homo sapiens
  Payload ID: 3772
  Gene Symbol: CCDC90B
  Gene Name: coiled-coil domain containing 90B
  ENSP ID: ENSP00000432646
MNSRQAWRLFLSQGRGDRWVSRPRGHFSPALRREFFTTTTKEGYDRRPVDITPLEQRKLTFDTHALVQDLETHGFDKTQAETIVSALTALSNVSLDTIYKEMVTQAQQVIFILFSRK

SEQ ID NO: 18792 - protein, 57 aa, Homo sapiens
  Payload ID: 3772
  Gene Symbol: CCDC90B
  Gene Name: coiled-coil domain containing 90B
  ENSP ID: ENSP00000432999
MNSRQAWRLFLSQGRGDRWVSRPRGHFSPALRRGNNSTTANGSFGCYQERHGHPREK

SEQ ID NO: 18793 - protein, 95 aa, Homo sapiens
  Payload ID: 3772
  Gene Symbol: CCDC90B
  Gene Name: coiled-coil domain containing 90B
  ENSP ID: ENSP00000433201
  MOD_RES (1)..(1): Any amino acid
XRQAWRLFLSQGRGDRWVSRPRGHFSPALRREFFTTTTKEGYDRRPVDITPLEQRKLTFDTHALVQDLETHGNNSTTANGSFGCYQERHGHPREK

SEQ ID NO: 18794 - protein, 43 aa, Homo sapiens
  Payload ID: 3772
  Gene Symbol: CCDC90B
  Gene Name: coiled-coil domain containing 90B
  ENSP ID: ENSP00000433992
MNSRQAWRLFLSQGRGDRWVSRPRGHFSPALRRGEARRRVIDA

SEQ ID NO: 18795 - protein, 57 aa, Homo sapiens; identical to SEQ ID NO: 18792
  Payload ID: 3772
  Gene Symbol: CCDC90B
  Gene Name: coiled-coil domain containing 90B
  ENSP ID: ENSP00000434078

SEQ ID NO: 18796 - protein, 97 aa, Homo sapiens
  Payload ID: 3772
  Gene Symbol: CCDC90B
  Gene Name: coiled-coil domain containing 90B
  ENSP ID: ENSP00000434242
MNSRQAWRLFLSQGRGDRWVSRPRGHFSPALRREFFTTTTKEGYDRRPVDITPLEQRKLTFDTHALVQDLETHGNNSTTANGSFGCYQERHGHPREK

SEQ ID NO: 18797 - protein, 254 aa, Homo sapiens
  Payload ID: 3772
  Gene Symbol: CCDC90B
  Gene Name: coiled-coil domain containing 90B
  Uniprot ID: Q9GZT6
  ENSP ID: ENSP00000434724
MNSRQAWRLFLSQGRGDRWVSRPRGHFSPALRREFFTTTTKEGYDRRPVDITPLEQRKLTFDTHALVQDLETHGFDKTQAETIVSALTALSNVSLDTIYKEMVTQAQQEITVQQLMAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 18798 - protein, 38 aa, Homo sapiens; identical to SEQ ID NO: 18790
  Payload ID: 3772
  Gene Symbol: CCDC90B
  Gene Name: coiled-coil domain containing 90B
  ENSP ID: ENSP00000434775

SEQ ID NO: 18799 - protein, 133 aa, Homo sapiens
  Payload ID: 3772
  Gene Symbol: CCDC90B
  Gene Name: coiled-coil domain containing 90B
  ENSP ID: ENSP00000436974
GFDKTQAETIVSALTALSNVSLDTIYKEMVTQAQQEITVQQLMAHLDAIRKDMVILEKSEFANLRAENEKMKIELDQVKQQLMHETSRIRADNKLDINLERSRVTDMFTDQEKQLMETTTEFTKKLRCLLAWQ

SEQ ID NO: 18800 - protein, 441 aa, Homo sapiens
  Payload ID: 3773
  Gene Symbol: CCDC91
  Gene Name: coiled-coil domain containing 91
  Uniprot ID: Q7Z6B0
  ENSP ID: ENSP00000370658
MDDDDFGGFEAAETFDGGSGETQTTSPAIPWAAFPAVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAVKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQLSALIATEPVDIE

SEQ ID NO: 18801 - protein, 441 aa, Homo sapiens; identical to SEQ ID NO: 18800
  Payload ID: 3773
  Gene Symbol: CCDC91
  Gene Name: coiled-coil domain containing 91
  Uniprot ID: Q7Z6B0
  ENSP ID: ENSP00000438040

SEQ ID NO: 18802 - protein, 55 aa, Homo sapiens
  Payload ID: 3773
  Gene Symbol: CCDC91
  Gene Name: coiled-coil domain containing 91
  ENSP ID: ENSP00000438558
MDDDDFGGFEAAETFDGGSGETQTTSPAIPWAAFPAGKHAIFIVSCLPEFMVELH

SEQ ID NO: 18803 - protein, 46 aa, Homo sapiens
  Payload ID: 3773
  Gene Symbol: CCDC91
  Gene Name: coiled-coil domain containing 91
  ENSP ID: ENSP00000439935
LDQVIRQRSLSSLELFLSCAQKQDTEGLLVRWQKRDMATRISLSRP

SEQ ID NO: 18804 - protein, 85 aa, Homo sapiens
  Payload ID: 3773
  Gene Symbol: CCDC91
  Gene Name: coiled-coil domain containing 91
  ENSP ID: ENSP00000440194
MDDDDFGGFEAAETFDGGSGETQTTSPAIPWAAFPAVSGVHLSPSSPEIVLDRDHSSSIGCLSSDAIISSPENTHAANSIVSQTI

SEQ ID NO: 18805 - protein, 405 aa, Homo sapiens
  Payload ID: 3773
  Gene Symbol: CCDC91
  Gene Name: coiled-coil domain containing 91
  Uniprot ID: Q7Z6B0
  ENSP ID: ENSP00000440513
MDDDDFGGFEAAETFDGGSGETQTTSPAIPWAAFPAVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKHQRLLEMLDTEKELLKEKIKEALIQQSQEQKEILEKCLEEERQRNKEALVSAAKLEKEAVKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQLSALIATEPVDIE

SEQ ID NO: 18806 - protein, 267 aa, Homo sapiens
  Payload ID: 3773
  Gene Symbol: CCDC91
  Gene Name: coiled-coil domain containing 91
  ENSP ID: ENSP00000441651
MDDDDFGGFEAAETFDGGSGETQTTSPAIPWAAFPAVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQSALFSILPAIGCF

SEQ ID NO: 18807 - protein, 120 aa, Homo sapiens
  Payload ID: 3773
  Gene Symbol: CCDC91
  Gene Name: coiled-coil domain containing 91
  ENSP ID: ENSP00000441714
MIVSFLRPPQPCKPALLQSSVKQQVEAIEKQYISAIEKQAHKCEELLNAQHQRLLEMLDTEKELLKEKIKEALIQQSQEQKEILEKCLEEERQRNKEALVSAAKLEKEAVKDAVLKVVEE

SEQ ID NO: 18808 - protein, 122 aa, Homo sapiens
  Payload ID: 3773
  Gene Symbol: CCDC91
  Gene Name: coiled-coil domain containing 91
  ENSP ID: ENSP00000442473
  MOD_RES (1)..(1): Any amino acid
XKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQDTEGLLVRWQKRDMATRISLSRP

SEQ ID NO: 18809 - protein, 362 aa, Homo sapiens
  Payload ID: 3773
  Gene Symbol: CCDC91
  Gene Name: coiled-coil domain containing 91
  ENSP ID: ENSP00000442544
MDDDDFGGFEAAETFDGGSGETQTTSPAIPWAAFPAVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAVKDAVLKVVEEERKNLEKAHAEERELWKTEHAKDQEKVSQEIQKAIQEQ

SEQ ID NO: 18810 - protein, 30 aa, Homo sapiens
  Payload ID: 3773
  Gene Symbol: CCDC91
  Gene Name: coiled-coil domain containing 91
  ENSP ID: ENSP00000444038
LDQVIRQRSLSSLELFLSCAQKQPRLTTGN

SEQ ID NO: 18811 - protein, 126 aa, Homo sapiens
  Payload ID: 3773
  Gene Symbol: CCDC91
  Gene Name: coiled-coil domain containing 91
  ENSP ID: ENSP00000444440
MLDTEKELLKEKIKEALIQQSQEQKEILEKCLEEERQRNKEALVSAAKLEKEAVKDAVLKVVEEERKNLEKAHAEERELWKTEHAKDQEKVSQEIQKAIQEQRKISQETVKAAIIEEQKRSEKAVE

SEQ ID NO: 18812 - protein, 361 aa, Homo sapiens
  Payload ID: 3773
  Gene Symbol: CCDC91
  Gene Name: coiled-coil domain containing 91
  ENSP ID: ENSP00000445660
MDDDDFGGFEAAETFDGGSGETQTTSPAIPWAAFPAVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAVKDAVLKVVEEERKNLEKAHAEERELWKTEHAKDQEKVSQEIQKAIQE

SEQ ID NO: 18813 - protein, 108 aa, Homo sapiens
  Payload ID: 3773
  Gene Symbol: CCDC91
  Gene Name: coiled-coil domain containing 91
  ENSP ID: ENSP00000445999
ALVSAAKLEKEAVKDAVLKVVEEERKNLEKAHAEERELWKTEHAKDQEKVSQEIQKAIQEQRKISQETVKAAIIEEQKRSEKAVEEAVKRTRDELIEYIKEQKRVSIS

SEQ ID NO: 18814 - protein, 91 aa, Homo sapiens
  Payload ID: 3773
  Gene Symbol: CCDC91
  Gene Name: coiled-coil domain containing 91
  ENSP ID: ENSP00000446045
MDDDDFGGFEAAETFDGGSGETQTTSPAIPWAAFPAVSGVHLSPSSPEIVLDRDHSSSIGCLSSDAIISSPENTHAANSIVSQTIPKAQIQ

SEQ ID NO: 18815 - protein, 27 aa, Homo sapiens
  Payload ID: 3773
  Gene Symbol: CCDC91
  Gene Name: coiled-coil domain containing 91
  ENSP ID: ENSP00000446059
  MOD_RES (1)..(1): Any amino acid
XDQVIRQRSLSSLELFLSCAQKQRSLA

SEQ ID NO: 18816 - protein, 30 aa, Homo sapiens; identical to SEQ ID NO: 18810
  Payload ID: 3773
  Gene Symbol: CCDC91
  Gene Name: coiled-coil domain containing 91
  ENSP ID: ENSP00000446329

SEQ ID NO: 18817 - protein, 331 aa, Homo sapiens
  Payload ID: 3774
  Gene Symbol: CCDC92
  Gene Name: coiled-coil domain containing 92
  Uniprot ID: Q53HC0
  ENSP ID: ENSP00000238156
MTSPHFSSYDEGPLDVSMAATNLENQLHSAQKNLLFLQREHASTLKGLHSEIRRLQQHCTDLTYELTVKSSEQTGDGTSKSSELKKRCEELEAQLKVKENENAELLKELEQKNAMITVLENTIKEREKKYLEELKAKSHKLTLLSSELEQRASTIAYLTSQLHAAKKKLMSSSGTSDASPSGSPVLASYKPAPPKDKLPETPRRRMKKSLSAPLHPEFEEVYRFGAESRKLLLREPVDAMPDPTPFLLARESAEVHLIKERPLVIPPIASDRSGEQHSPAREKPHKAHVGVAHRIHHATPPQAQPEVKTLAVDQVNGGKVVRKHSGTDRTV

SEQ ID NO: 18818 - protein, 96 aa, Homo sapiens
  Payload ID: 3774
  Gene Symbol: CCDC92
  Gene Name: coiled-coil domain containing 92
  ENSP ID: ENSP00000438281
MAATNLENQLHSAQKNLLFLQREHASTLKGLHSEIRRLQQHCTDLTYELTVKSSEQTGDGTSKSSELKKRCEELEAQLKVKENENAELLKELEQKN

SEQ ID NO: 18819 - protein, 122 aa, Homo sapiens
  Payload ID: 3774
  Gene Symbol: CCDC92
  Gene Name: coiled-coil domain containing 92
  ENSP ID: ENSP00000439441
MTSPHFSSYDEGPLDVSMAATNLENQLHSAQKNLLFLQREHASTLKGLHSEIRRLQQHCTDLTYELTVKSSEQTGDGTSKSSELKKRCEELEAQLKVKENENAELLKELEQKNAMITVLENT

SEQ ID NO: 18820 - protein, 314 aa, Homo sapiens
  Payload ID: 3774
  Gene Symbol: CCDC92
  Gene Name: coiled-coil domain containing 92
  Uniprot ID: Q53HC0
  ENSP ID: ENSP00000439526
MAATNLENQLHSAQKNLLFLQREHASTLKGLHSEIRRLQQHCTDLTYELTVKSSEQTGDGTSKSSELKKRCEELEAQLKVKENENAELLKELEQKNAMITVLENTIKEREKKYLEELKAKSHKLTLLSSELEQRASTIAYLTSQLHAAKKKLMSSSGTSDASPSGSPVLASYKPAPPKDKLPETPRRRMKKSLSAPLHPEFEEVYRFGAESRKLLLREPVDAMPDPTPFLLARESAEVHLIKERPLVIPPIASDRSGEQHSPAREKPHKAHVGVAHRIHHATPPQAQPEVKTLAVDQVNGGKVVRKHSGTDRTV

SEQ ID NO: 18821 - protein, 314 aa, Homo sapiens; identical to SEQ ID NO: 18820
  Payload ID: 3774
  Gene Symbol: CCDC92
  Gene Name: coiled-coil domain containing 92
  Uniprot ID: Q53HC0
  ENSP ID: ENSP00000440024

SEQ ID NO: 18822 - protein, 12 aa, Homo sapiens
  Payload ID: 3774
  Gene Symbol: CCDC92
  Gene Name: coiled-coil domain containing 92
  ENSP ID: ENSP00000440203
MTSPHFSSYDEG

SEQ ID NO: 18823 - protein, 96 aa, Homo sapiens
  Payload ID: 3774
  Gene Symbol: CCDC92
  Gene Name: coiled-coil domain containing 92
  ENSP ID: ENSP00000442369
MTSPHFSSYDEGPLDVSMAATNLENQLHSAQKNLLFLQREHASTLKGLHSEIRRLQQHCTDLTYELTVKSSEQTGDGTSKSSELKKRCEELEAQLK

SEQ ID NO: 18824 - protein, 314 aa, Homo sapiens; identical to SEQ ID NO: 18820
  Payload ID: 3774
  Gene Symbol: CCDC92
  Gene Name: coiled-coil domain containing 92
  Uniprot ID: Q53HC0
  ENSP ID: ENSP00000479437

SEQ ID NO: 18825 - protein, 96 aa, Homo sapiens; identical to SEQ ID NO: 18823
  Payload ID: 3774
  Gene Symbol: CCDC92
  Gene Name: coiled-coil domain containing 92
  ENSP ID: ENSP00000487647

SEQ ID NO: 18826 - protein, 314 aa, Homo sapiens; identical to SEQ ID NO: 18820
  Payload ID: 3774
  Gene Symbol: CCDC92
  Gene Name: coiled-coil domain containing 92
  Uniprot ID: Q53HC0
  ENSP ID: ENSP00000487695

SEQ ID NO: 18827 - protein, 17 aa, Homo sapiens
  Payload ID: 3774
  Gene Symbol: CCDC92
  Gene Name: coiled-coil domain containing 92
  ENSP ID: ENSP00000488154
MTSPHFSSYDEGPLDVS

SEQ ID NO: 18828 - protein, 122 aa, Homo sapiens; identical to SEQ ID NO: 18819
  Payload ID: 3774
  Gene Symbol: CCDC92
  Gene Name: coiled-coil domain containing 92
  ENSP ID: ENSP00000488169

SEQ ID NO: 18829 - protein, 96 aa, Homo sapiens; identical to SEQ ID NO: 18818
  Payload ID: 3774
  Gene Symbol: CCDC92
  Gene Name: coiled-coil domain containing 92
  ENSP ID: ENSP00000488179

SEQ ID NO: 18830 - protein, 331 aa, Homo sapiens; identical to SEQ ID NO: 18817
  Payload ID: 3774
  Gene Symbol: CCDC92
  Gene Name: coiled-coil domain containing 92
  Uniprot ID: Q53HC0
  ENSP ID: ENSP00000488830

SEQ ID NO: 18831 - protein, 630 aa, Homo sapiens
  Payload ID: 3775
  Gene Symbol: CCDC93
  Gene Name: coiled-coil domain containing 93
  ENSP ID: ENSP00000324135
MGLPRGPEGQGLPEVETREDEEQNVKLTEILELLVAAGYFRARIKGLSPFDKVVGGMTWCITTCNFDVDVDLLFQENSTIGQKIALSEKIVSVLPRMKCPHQLEPHQIQGMDFIHIFPVVQWLVKRAIETKEEMGDYIRSYSVSQFQKTYSLPEDDDFIKRKEKAIKTVVDLSEVYKPRRKYKRHQGAEELLDEESRIHATLLEYGRYGFSRQSKMEKAEDKKTALPAGLSATEKADAHEEDELRAAEEQRIQSLMTKMTAMANEESRLTASSVGQIVGLCSAEIKQIVSEYAEKQSELSAEESPEKLGTSQLHRRKVISLNKQIAQKTKHLEELRASHTSLQARYNEAKKTLTELKTYSEKLDKEQAALEKIESKADPSILQNLRALVAMNENLKSQEQEFKAHCREEMTRLQQEIENLKAERAPRGDEKTLSSGEPPGTLTSAMTHDEDLDRRYNMEKEKLYKIRLLQARRNREIAILHRKIDEVPSRAELIQYQKRFIELYRQISAVHKETKQFFTLYNTLDDKKVYLEKEISLLNSIHENFSQAMASPAARDQFLRQMEQIVEGIKQSRMKMEKKKQENKMRRDQLNDQYLELLEKQRLYFKTVKEFKEEGRKNEMLLSKVKAKAS

SEQ ID NO: 18832 - protein, 631 aa, Homo sapiens
  Payload ID: 3775
  Gene Symbol: CCDC93
  Gene Name: coiled-coil domain containing 93
  Uniprot ID: Q567U6
  ENSP ID: ENSP00000365477
MGLPRGPEGQGLPEVETREDEEQNVKLTEILELLVAAGYFRARIKGLSPFDKVVGGMTWCITTCNFDVDVDLLFQENSTIGQKIALSEKIVSVLPRMKCPHQLEPHQIQGMDFIHIFPVVQWLVKRAIETKEEMGDYIRSYSVSQFQKTYSLPEDDDFIKRKEKAIKTVVDLSEVYKPRRKYKRHQGAEELLDEESRIHATLLEYGRRYGFSRQSKMEKAEDKKTALPAGLSATEKADAHEEDELRAAEEQRIQSLMTKMTAMANEESRLTASSVGQIVGLCSAEIKQIVSEYAEKQSELSAEESPEKLGTSQLHRRKVISLNKQIAQKTKHLEELRASHTSLQARYNEAKKTLTELKTYSEKLDKEQAALEKIESKADPSILQNLRALVAMNENLKSQEQEFKAHCREEMTRLQQEIENLKAERAPRGDEKTLSSGEPPGTLTSAMTHDEDLDRRYNMEKEKLYKIRLLQARRNREIAILHRKIDEVPSRAELIQYQKRFIELYRQISAVHKETKQFFTLYNTLDDKKVYLEKEISLLNSIHENFSQAMASPAARDQFLRQMEQIVEGIKQSRMKMEKKKQENKMRRDQLNDQYLELLEKQRLYFKTVKEFKEEGRKNEMLLSKVKAKAS

SEQ ID NO: 18833 - protein, 91 aa, Homo sapiens
  Payload ID: 3775
  Gene Symbol: CCDC93
  Gene Name: coiled-coil domain containing 93
  ENSP ID: ENSP00000392989
QNLRALVAMNENLKSQEQEFKAHCREEMTRLQQEIENLKAERAPRGDEKTLSSGEPPGTLTSAMTHDENELQHSSSEVCWILPAAEPLGKT

SEQ ID NO: 18834 - protein, 323 aa, Homo sapiens
  Payload ID: 3776
  Gene Symbol: CCDC94
  Gene Name: coiled-coil domain containing 94
  Uniprot ID: Q9BW85
  ENSP ID: ENSP00000262962
MSERKVLNKYYPPDFDPSKIPKLKLPKDRQYVVRLMAPFNMRCKTCGEYIYKGKKFNARKETVQNEVYLGLPIFRFYIKCTRCLAEITFKTDPENTDYTMEHGATRNFQAEKLLEEEEKRVQKEREDEELNNPMKVLENRTKDSKLEMEVLENLQELKDLNQRQAHVDFEAMLRQHRLSEEERRRQQQEEDEQETAALLEEARKRRLLEDSDSEDEAAPSPLQPALRPNPTAILDEAPKPKRKVEVWEQSVGSLGSRPPLSRLVVVKKAKADPDCSNGQPQAAPTPGAPQNRKEANPTPLTPGASSLSQLGAYLDSDDSNGSN

SEQ ID NO: 18835 - protein, 160 aa, Homo sapiens
  Payload ID: 3776
  Gene Symbol: CCDC94
  Gene Name: coiled-coil domain containing 94
  ENSP ID: ENSP00000472772
MAPFNMRCKTCGEYIYKGKKFNARKETVQNEVYLGLPIFRFYIKCTRCLAEITFKTDPENTDYTMEHGATRNFQAEKLLEEEEKRVQKEREDEELNNPMKVLENRTKDSKLEMEVLENLQELKDLNQRQAHVDFEAMLRQHRLSEEERRRQQQEEDEQET

SEQ ID NO: 18836 - protein, 555 aa, Homo sapiens
  Payload ID: 3777
  Gene Symbol: CCDC96
  Gene Name: coiled-coil domain containing 96
  Uniprot ID: Q2M329
  ENSP ID: ENSP00000309285
MDVSSEHTKDPGGEGGDGESLAARPSKIKASSGPPTSPEPGELESEPEEEEEEQAASQGGTAADEQAEAPKGLTAAEAAGEEGPGEPGRPAEPQPEPEEPAEVGAEEPAQPEPGAGPEELEAEAGAEELEQAAEGKEVRFQASLPLTRIDEEEAAAAPEAETERVEGEEEDKEETQRDGAESKERDGEGRPAKSQEEGKRLYGRDEFEDLEWSEEVQKLQEQQLRSDLLDQYRSLLVERNRSQRYNLYLQHKIFEALRRKKGLEAAEVADRGAEAEAPEKEQAYLRHLGMLEELKKQQADDLQWYHQELGQLKRQCQEKLTRVEKEWRRFQALKKQVVMQAMGSCRMRGGRQAALREVEQIQALEDKKEKEMSAVRLENIQLKQSLVHFETRMRTQEDLTQGLLLIDFEQLKIENQTFNEKIEERNEELLKLRSKVTNSVQVITHVKEKLHFMDMENACKKTQLAEIEAQAALGRDILTKTKQAREGLRTDNIRLNQKCGLLGKDSLLRDLEEKVDKTELLHRRLESLKRHHASLTLSCRGVRQKIREAKAFLPS

SEQ ID NO: 18837 - protein, 343 aa, Homo sapiens
  Payload ID: 3778
  Gene Symbol: CCDC97
  Gene Name: coiled-coil domain containing 97
  Uniprot ID: Q96F63
  ENSP ID: ENSP00000269967
MEAVATATAAKEPDKGCIEPGPGHWGELSRTPVPSKPQDKVEAAEATPVALDSDTSGAENAAVSAMLHAVAASRLPVCSQQQGEPDLTEHEKVAILAQLYHEKPLVFLERFRTGLREEHLACFGHVRGDHRADFYCAEVARQGTARPRTLRTRLRNRRYAALRELIQGGEYFSDEQMRFRAPLLYEQYIGQYLTQEELSARTPTHQPPKPGSPGRPACPLSNLLLQSYEERELQQRLLQQQEEEEACLEEEEEEEDSDEEDQRSGKDSEAWVPDSEERLILREEFTSRMHQRFLDGKDGDFDYSTVDDNPDFDNLDIVARDEEERYFDEEEPEDAPSPELDGD

SEQ ID NO: 18838 - protein, 154 aa, Homo sapiens
  Payload ID: 3778
  Gene Symbol: CCDC97
  Gene Name: coiled-coil domain containing 97
  ENSP ID: ENSP00000469348
  MOD_RES (1)..(1): Any amino acid
XNLLLQSYEERELQQRLLQQQEEEEACLEEEEEEEDSDEEDQRSGKDSEAWVPDSEERLILREEFTSRMHQRFLDGKDGDFDYRCSCASTSPSPSPASHGLWSHAEPLTSCGGLPLWSYKAPKQFQDVGLNSQRKRLGDLGLALSISDPQSPHL

SEQ ID NO: 18839 - protein, 16 aa, Homo sapiens
  Payload ID: 3778
  Gene Symbol: CCDC97
  Gene Name: coiled-coil domain containing 97
  ENSP ID: ENSP00000470858
MLHAVAASRLPVCSQQ

SEQ ID NO: 18840 - protein, 266 aa, Homo sapiens
  Payload ID: 3779
  Gene Symbol: CCER2
  Gene Name: Coiled-coil glutamate rich protein 2
  ENSP ID: ENSP00000488939
MPPRGPASELLLLRLLLLGAATAAPLAPRPSKEELTRCLAEVVTEVLTVGQVQRGPCTALLHKELCGTEPHGCASTEEKGLLLGDFKKQEAGKMRSSQEVRDEEEEEVAERTHKSEVQEQAIRMQGHRQLHQEEDEEEEKEERKRGPMETFEDLWQRHLENGGDLQKRVAEKASDKETAQFQAEEKGVRVLGGDRSLWQGAERGGGERREDLPHHHHHHHQPEAEPRQEKEEASEREEKEVEQLEHLRDELKKVTETLGEQLRREG

SEQ ID NO: 18841 - protein, 122 aa, Homo sapiens
  Payload ID: 3779
  Gene Symbol: CCER2
  Gene Name: Coiled-coil glutamate rich protein 2
  ENSP ID: ENSP00000489598
EDEEEEKEERKRGPMETFEDLWQRHLENGGDLQKRVAEKASDKETAQFQAEEKGVRVLGGDRSLWQGAERGGGERREDLPHHHHHHHQPEAEPRQEKEEASEREEKEVEQLEHLRDELKKDC

SEQ ID NO: 18842 - protein, 406 aa, Homo sapiens
  Payload ID: 3780
  Gene Symbol: CCER1
  Gene Name: coiled-coil glutamate-rich protein 1
  Uniprot ID: Q8TC90
  ENSP ID: ENSP00000351727
MTQTLDTREDPLNLGGGGGGGCGCGWAHSASLSSWSSCHRRRPGAPAYNRPHRYSPKTEYGPPRKQPKQQHGPGFWFQPPVCSNWGCWGGPWRPPPPGFWKFPCPVQVFRVYGLHPLCFCCCSCWSGSWNPGWVKPPGRKKRWGRRGRGLRHHPRHSYPRSPPADVSTLPRPVKLYEWREPGMRAPPNTTQFIMNQIYEDMRQQEKVERQQEALRAQKATVSGEASPARSSGNDAPPGGSKETWGLQETLYGFVQNPSLAFSPNPEENQSLAPLLVEEEEEKKNDDEEEYDQEVCDAKEASEEEEEVEDEEEEVEDEEEEEVEEAEYVEEGEEELEEEELEEEEEVLEENEQRGEEFHLPLEMPLSIFVEAEEKRENFISCTFLNPEQIIPKVPQESLFMAQDFNC

SEQ ID NO: 18843 - protein, 58 aa, Homo sapiens
  Payload ID: 3780
  Gene Symbol: CCER1
  Gene Name: coiled-coil glutamate-rich protein 1
  ENSP ID: ENSP00000446773
  MOD_RES (1)..(1): Any amino acid
XNEQRGEEFHLPLEMPLSIFVEAEEKRENFISCTFLNPEQIIPKVPQESLFMAQDFNC

SEQ ID NO: 18844 - protein, 266 aa, Homo sapiens; identical to SEQ ID NO: 18840
  Payload ID: 3781
  Gene Symbol: CCER2
  Gene Name: coiled-coil glutamate-rich protein 2
  Uniprot ID: I3L3R5
  ENSP ID: ENSP00000460665

SEQ ID NO: 18845 - protein, 122 aa, Homo sapiens; identical to SEQ ID NO: 18841
  Payload ID: 3781
  Gene Symbol: CCER2
  Gene Name: coiled-coil glutamate-rich protein 2
  ENSP ID: ENSP00000460852

SEQ ID NO: 18846 - protein, 677 aa, Homo sapiens
  Payload ID: 3782
  Gene Symbol: CCSER1
  Gene Name: coiled-coil serine-rich protein 1
  Uniprot ID: Q9C0I3
  ENSP ID: ENSP00000389283
MGDSGSRRSTLVSRLPIFRRSINRRHDSLPSSPSSSNTVGVHSSSPSSTNSSSGSTGKRRSIFRTPSISFHHKKGSEPKQEPTNQNLSISNGAQPGHSNMQKLSLEEHIKTRGRHSVGFSSSRNKKITRSLTEDFEREKEHSTNKNVFINCLSSGKSEGDDSGFTEDQTRRSVKQSTRKLLPKSFSSHYKFSKPVLQSQSISLVQQSEFSLEVTQYQEREPVLVRASPSCSVDVTERAGSSLQSPLLSADLTTAQTPSEFLALTEDSVSEMDAFSKSGSMASHCDNFGHNDSTSQMSLNSAAVTKTTTELTGTVPCAIMSPGKYRLEGQCSTESNSLPETSAANQKEVLLQIAELPATSVSHSESNLPADSEREENIGLQNGETMLGTNSPRKLGFYEQHKAIAEHVKGIHPISDSKIIPTSGDHHIFNKTSHGYEANPAKVLASSLSPFREGRFIERRLRSSSEGTAGSSRMILKPKDGNIEEVNSLRKQRAGSSSSKMNSLDVLNNLGSCELDEDDLMLDLEFLEEQSLHPSVCREDSYHSVVSCAAVVLTPMEPMIEMKKREEPEFPEPSKQNLSLKLTKDVDQEARCSHISRMPNSPSADWPLQGVEENGGIDSLPFRLMLQDCTAVKTLLLKMKRVLQESADMSPASSTTSLPVSPLTEEPVPFKTTYPREF

SEQ ID NO: 18847 - protein, 663 aa, Homo sapiens
  Payload ID: 3782
  Gene Symbol: CCSER1
  Gene Name: coiled-coil serine-rich protein 1
  ENSP ID: ENSP00000420964
MGDSGSRRSTLVSRLPIFRRSINRRHDSLPSSPSSSNTVGVHSSSPSSTNSSSGSTGKRRSIFRTPSISFHHKKGSEPKQEPTNQNLSISNGAQPGHSNMQKLSLEEHIKTRGRHSVGFSSSRNKKITRSLTEDFEREKEHSTNKNVFINCLSSGKSEGDDSGFTEDQTRRSVKQSTRKLLPKSFSSHYKFSKPVLQSQSISLVQQSEFSLEVTQYQEREPVLVRASPSCSVDVTERAGSSLQSPLLSADLTTAQTPSEFLALTEDSVSEMDAFSKSGSMASHCDNFGHNDSTSQMSLNSAAVTKTTTELTGTVPCAIMSPGKYRLEGQCSTESNSLPETSAANQKEVLLQIAELPATSVSHSESNLPADSEREENIGLQNGETMLGTNSPRKLGFYEQHKAIAEHVKGIHPISDSKIIPTSGDHHIFNKTSHGYEANPAKVLASSLSPFREGRFIERRLRSSSEGTAGSSRMILKPKDGNIEEVNSLRKQRAGSSSSKMNSLDVLNNLGSCELDEDDLMLDLEFLEEQSLHPSVCREDSYHSVVSCAAVVLTPMEPMIEMKKREEPEFPEPSKQNLSLKLTKDVDQEARCSHISRMPNSPSADWPLQGVEENGGIDSLPFRLMLQDCTAVKTLLLKMKRVLQEVHLSRMSVSNSTNKNCIIF

SEQ ID NO: 18848 - protein, 70 aa, Homo sapiens
  Payload ID: 3782
  Gene Symbol: CCSER1
  Gene Name: coiled-coil serine-rich protein 1
  ENSP ID: ENSP00000421678
MSPASSTTSLPVSPLTEEPVPFKDIMKDECSMLKLQLKEKDELISQLQEELLPKILCSMRGGFICLAVFL

SEQ ID NO: 18849 - protein, 93 aa, Homo sapiens
  Payload ID: 3782
  Gene Symbol: CCSER1
  Gene Name: coiled-coil serine-rich protein 1
  ENSP ID: ENSP00000421693
MSPASSTTSLPVSPLTEEPVPFKDIMKDECSMLKLQLKEKDELISQLQEELLPKILCSMRGGFICLAVFLEDSTDVFSDMHAPIKDSKANYYT

SEQ ID NO: 18850 - protein, 169 aa, Homo sapiens
  Payload ID: 3782
  Gene Symbol: CCSER1
  Gene Name: coiled-coil serine-rich protein 1
  ENSP ID: ENSP00000424033
  MOD_RES (1)..(1): Any amino acid
XNLSLKLTKDVDQEARCSHISRMPNSPSADWPLQGVEENGGIDSLPFRLMLQDCTAVKTLLLKMKRVLQESADMSPASSTTSLPVSPLTEEPVPFKDIMKDECSMLKLQLKEKDELISQLQEELGKVRHLQKAFASRVDKSTQTELLCYDALWNPTCTEGLFKPVLIST

SEQ ID NO: 18851 - protein, 58 aa, Homo sapiens
  Payload ID: 3782
  Gene Symbol: CCSER1
  Gene Name: coiled-coil serine-rich protein 1
  ENSP ID: ENSP00000424376
MSPASSTTSLPVSPLTEEPVPFKNIQHYINCTHIWSDTCHCIIIEEPKDNQFCIDHIP

SEQ ID NO: 18852 - protein, 900 aa, Homo sapiens
  Payload ID: 3782
  Gene Symbol: CCSER1
  Gene Name: coiled-coil serine-rich protein 1
  Uniprot ID: Q9C0I3
  ENSP ID: ENSP00000425040
MGDSGSRRSTLVSRLPIFRRSINRRHDSLPSSPSSSNTVGVHSSSPSSTNSSSGSTGKRRSIFRTPSISFHHKKGSEPKQEPTNQNLSISNGAQPGHSNMQKLSLEEHIKTRGRHSVGFSSSRNKKITRSLTEDFEREKEHSTNKNVFINCLSSGKSEGDDSGFTEDQTRRSVKQSTRKLLPKSFSSHYKFSKPVLQSQSISLVQQSEFSLEVTQYQEREPVLVRASPSCSVDVTERAGSSLQSPLLSADLTTAQTPSEFLALTEDSVSEMDAFSKSGSMASHCDNFGHNDSTSQMSLNSAAVTKTTTELTGTVPCAIMSPGKYRLEGQCSTESNSLPETSAANQKEVLLQIAELPATSVSHSESNLPADSEREENIGLQNGETMLGTNSPRKLGFYEQHKAIAEHVKGIHPISDSKIIPTSGDHHIFNKTSHGYEANPAKVLASSLSPFREGRFIERRLRSSSEGTAGSSRMILKPKDGNIEEVNSLRKQRAGSSSSKMNSLDVLNNLGSCELDEDDLMLDLEFLEEQSLHPSVCREDSYHSVVSCAAVVLTPMEPMIEMKKREEPEFPEPSKQNLSLKLTKDVDQEARCSHISRMPNSPSADWPLQGVEENGGIDSLPFRLMLQDCTAVKTLLLKMKRVLQESADMSPASSTTSLPVSPLTEEPVPFKDIMKDECSMLKLQLKEKDELISQLQEELGKVRHLQKAFASRVDKSTQTELLCYDGLNLKRLETVQGGREATYRNRIVSQNLSTRDRKAIHTPTEDRFRYSAADQTSPYKNKTCQLPSLCLSNFLKDKELAEVIKHSRGTYETLTSDVTQNLRATVGQSSLKPTAKTEGLSTFLEKPKDQVATARQHSTFTGRFGQPPRGPISLHMYSRKNVFLHHNLHSTELQTLGQQDG

SEQ ID NO: 18853 - protein, 137 aa, Homo sapiens
  Payload ID: 3782
  Gene Symbol: CCSER1
  Gene Name: coiled-coil serine-rich protein 1
  ENSP ID: ENSP00000426310
  MOD_RES (1)..(1): Any amino acid
XAEHVKGIHPISDSKIIPTSGDHHIFNKTSHGYEANPAKVLASSLSPFREGRFIERRLRSSSEGTAGSSRMILKPKDGNIEEVNSLRKQRAGSSSSKMNSLGLRQISDHLNRCFTICSTELTFSKLTTCSEVTVTGI

SEQ ID NO: 18854 - protein, 74 aa, Homo sapiens
  Payload ID: 3782
  Gene Symbol: CCSER1
  Gene Name: coiled-coil serine-rich protein 1
  ENSP ID: ENSP00000427172
  MOD_RES (1)..(1): Any amino acid
XRNLSLKLTKDVDQEARCSHISRMPNSPSADWPLQGVEENGGIDSLPFRLMLQDCTAVKTLLLKMKRVLQEFSS

SEQ ID NO: 18855 - protein, 834 aa, Homo sapiens
  Payload ID: 3783
  Gene Symbol: CCSER2
  Gene Name: coiled-coil serine-rich protein 2
  Uniprot ID: Q9H7U1
  ENSP ID: ENSP00000224756
MEEKTQIKTFLGSKLPKYGTKSVRSTLQPMPNGTPVNLLGTSKNSNVKSYIKNNGSDCPSSHSFNWRKANKYQLCAQGVEEPNNTQNSHDKIIDPEKRVPTQGMFDKNGIKGGLKSVSLFTSKLAKPSTMFVSSTEELNQKSFSGPSNLGKFTKGTLLGRTSYSSINTPKSQLNGFYGNRSAGSMQRPRANSCATRSSSGESLAQSPDSSKSINCEKMVRSQSFSHSIQNSFLPPSSITRSHSFNRAVDLTKPYQNQQLSIRVPLRSSMLTRNSRQPEVLNGNEHLGYGFNRPYAAGGKKLALPNGPGVTSTLGYRMVHPSLLKSSRSPFSGTMTVDGNKNSPADTCVEEDATVLAKDRAANKDQELIENESYRTKNNQTMKHDAKMRYLSDDVDDISLSSLSSSDKNDLSEDFSDDFIDIEDSNRTRITPEEMSLKEEKHENGPPQDMFDSPKENEKAFSKTDEWIDISVSDRSECTKHTSGNNLVSPDTDYRAGSSFELSPSDSSDGTYMWDEEGLEPIGNVHPVGSYESSEMNSIDILNNLESCDLEDDDLMLDVDLPEDAPLENVECDNMNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDGSGSLHDIQLSLPSSPEPEDGDKVYKNEDLLNEIKQLKDEIKKKDEKIQLLELQLATQHICHQKCKEEKCTYADKYTQTPWRRIPGGYSAPSFSPWQGSFQGIPRTVPPHRRQTSSTTAFQQPSQTHRSHPGKTNKATTYRGPQ

SEQ ID NO: 18856 - protein, 567 aa, Homo sapiens
  Payload ID: 3783
  Gene Symbol: CCSER2
  Gene Name: coiled-coil serine-rich protein 2
  Uniprot ID: Q9H7U1
  ENSP ID: ENSP00000353068
MEEKTQIKTFLGSKLPKYGTKSVRSTLQPMPNGTPVNLLGTSKNSNVKSYIKNNGSDCPSSHSFNWRKANKYQLCAQGVEEPNNTQNSHDKIIDPEKRVPTQGMFDKNGIKGGLKSVSLFTSKLAKPSTMFVSSTEELNQKSFSGPSNLGKFTKGTLLGRTSYSSINTPKSQLNGFYGNRSAGSMQRPRANSCATRSSSGESLAQSPDSSKSINCEKMVRSQSFSHSIQNSFLPPSSITRSHSFNRAVDLTKPYQNQQLSIRVPLRSSMLTRNSRQPEVLNGNEHLGYGFNRPYAAGGKKLALPNGPGVTSTLGYRMVHPSLLKSSRSPFSGTMTVDGNKNSPADTCVEEDATVLAKDRAANKDQELIENESYRTKNNQTMKHDAKMRYLSDDVDDISLSSLSSSDKNDLSEDFSDDFIDIEDSNRTRITPEEMSLKEEKHENGPPQDMFDSPKENEKAFSKTDEWIDISVSDRSECTKHTSGNNLVSPDTDYRAGSSFELSPSDSSDGTYMWDEEGLEPIGNVHPVGSYESSEMNSIVCMDLYTLGIFCLPYYRETCDMIDFVKNL

SEQ ID NO: 18857 - protein, 1047 aa, Homo sapiens
  Payload ID: 3783
  Gene Symbol: CCSER2
  Gene Name: coiled-coil serine-rich protein 2
  Uniprot ID: Q9H7U1
  ENSP ID: ENSP00000361160
MEEKTQIKTFLGSKLPKYGTKSVRSTLQPMPNGTPVNLLGTSKNSNVKSYIKNNGSDCPSSHSFNWRKANKYQLCAQGVEEPNNTQNSHDKIIDPEKRVPTQGMFDKNGIKGGLKSVSLFTSKLAKPSTMFVSSTEELNQKSFSGPSNLGKFTKGTLLGRTSYSSINTPKSQLNGFYGNRSAGSMQRPRANSCATRSSSGESLAQSPDSSKSINCEKMVRSQSFSHSIQNSFLPPSSITRSHSFNRAVDLTKPYQNQQLSIRVPLRSSMLTRNSRQPEVLNGNEHLGYGFNRPYAAGGKKLALPNGPGVTSTLGYRMVHPSLLKSSRSPFSGTMTVDGNKNSPADTCVEEDATVLAKDRAANKDQELIENESYRTKNNQTMKHDAKMRYLSDDVDDISLSSLSSSDKNDLSEDFSDDFIDIEDSNRTRITPEEMSLKEEKHENGPPQDMFDSPKENEKAFSKTDEWIDISVSDRSECTKHTSGNNLVSPDTDYRAGSSFELSPSDSSDGTYMWDEEGLEPIGNVHPVGSYESSEMNSIDILNNLESCDLEDDDLMLDVDLPEDAPLENVECDNMNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDGSGSLHDIQLSLPSSPEPEDGDKVYKNEDLLNEIKQLKDEIKKKDEKIQLLELQLATQHICHQKCKEEKCTYADKYTQTPWRRIPPQVLQPSSSLPRPTDHTQGKLIKPQRIEARSECSIQDMHQGGAHPEESFTHVLHQESNYGLEEQPFSSGPQLTMDVAKSTPSEANLNITVNAQEPYHLANNQISDMQFIPTSLQTPPESSTVDQAKRVGRNQSPPVGYMSQPKSLQLLKPSILSSLVPPPVSESSPSRTPTCKKSPIITTCNSAKLQPTSSQTNLANNQNLKASKLRPPSGSFKQKQTNSPQLEPQSFQAKTSIPRPLTQRKEIMQNPNGNLHSGDCLASNRYSRLPKPKIH

SEQ ID NO: 18858 - protein, 261 aa, Homo sapiens
  Payload ID: 3783
  Gene Symbol: CCSER2
  Gene Name: coiled-coil serine-rich protein 2
  Uniprot ID: Q9H7U1
  ENSP ID: ENSP00000439944
MNRFDRPDRNVRQPQEGFWKRPPQRWSGQEHYHLSHPDHYHHHGKSDLSRGSPYRESPLGHFESYGGMPFFQAQKMFVDVPENTVILDEMTLRHMVQDCTAVKTQLLKLKRLLHQHDGSGSLHDIQLSLPSSPEPEDGDKVYKNEDLLNEIKQLKDEIKKKDEKIQLLELQLATQHICHQKCKEEKCTYADKYTQTPWRRIPGGYSAPSFSPWQGSFQGIPRTVPPHRRQTSSTTAFQQPSQTHRSHPGKTNKATTYRGPQ

SEQ ID NO: 18859 - protein, 118 aa, Homo sapiens
  Payload ID: 3784
  Gene Symbol: CHCHD1
  Gene Name: coiled-coil-helix-coiled-coil-helix domain containing 1
  Uniprot ID: Q96BP2
  ENSP ID: ENSP00000361923
MATPSLRGRLARFGNPRKPVLKPNKPLILANRVGERRREKGEATCITEMSVMMACWKQNEFRDDACRKEIQGFLDCAARAQEARKMRSIQETLGESGSLLPNKLNKLLQRFPNKPYLS

SEQ ID NO: 18860 - protein, 97 aa, Homo sapiens
  Payload ID: 3784
  Gene Symbol: CHCHD1
  Gene Name: coiled-coil-helix-coiled-coil-helix domain containing 1
  ENSP ID: ENSP00000361928
MATPSLRGRLARFGNPRKPVLKPNKPLILANRVGERRREKGEATCITEMSVMMACWKQNEFRDDACRKEIQGFLDCAARAQVTDGSWGAFSGKEWGR

SEQ ID NO: 18861 - protein, 149 aa, Homo sapiens
  Payload ID: 3785
  Gene Symbol: CHCHD10
  Gene Name: coiled-coil-helix-coiled-coil-helix domain containing 10
  ENSP ID: ENSP00000384973
MPRGSRSAASRPASRPAAPSAHPPAHPPPSAAAPAPAPSGQPGLMAQMATTAAGVAVGSAVGHVMGSALTGAFSGGSSEPSQPAVQQPLALYPQAPTPAAPQPLQMGPCAYEIRQFLDCSTTQSDLSLCEGFSEALKQCKYYHGLSSLP

SEQ ID NO: 18862 - protein, 142 aa, Homo sapiens
  Payload ID: 3785
  Gene Symbol: CHCHD10
  Gene Name: coiled-coil-helix-coiled-coil-helix domain containing 10
  Uniprot ID: Q8WYQ3
  ENSP ID: ENSP00000418428
MPRGSRSAASRPASRPAAPSAHPPAHPPPSAAAPAPAPSGQPGLMAQMATTAAGVAVGSAVGHVMGSALTGAFSGGSSEPSQPAVQQAPTPAAPQPLQMGPCAYEIRQFLDCSTTQSDLSLCEGFSEALKQCKYYHGLSSLP

SEQ ID NO: 18863 - protein, 99 aa, Homo sapiens
  Payload ID: 3785
  Gene Symbol: CHCHD10
  Gene Name: coiled-coil-helix-coiled-coil-helix domain containing 10
  ENSP ID: ENSP00000429976
MPRGSRSAASRPASRPSPRPFGPAGAHGSDGDHGRRGSRGLGCGTRHGQRPDRSLQRGELGALPACCPAGPHPRCPPAPADGALRLRDQAVPGLFHHSE

SEQ ID NO: 18864 - protein, 55 aa, Homo sapiens
  Payload ID: 3785
  Gene Symbol: CHCHD10
  Gene Name: coiled-coil-helix-coiled-coil-helix domain containing 10
  ENSP ID: ENSP00000430042
MPRGSRSAASRPARPPPPLPPSPCRWGPAPTRSGSSWTVPPLRVTCPCVRASARP

SEQ ID NO: 18865 - protein, 149 aa, Homo sapiens; identical to SEQ ID NO: 18861
  Payload ID: 3785
  Gene Symbol: CHCHD10
  Gene Name: coiled-coil-helix-coiled-coil-helix domain containing 10
  ENSP ID: ENSP00000480602

SEQ ID NO: 18866 - protein, 55 aa, Homo sapiens; identical to SEQ ID NO: 18864
  Payload ID: 3785
  Gene Symbol: CHCHD10
  Gene Name: coiled-coil-helix-coiled-coil-helix domain containing 10
  ENSP ID: ENSP00000486207

SEQ ID NO: 18867 - protein, 99 aa, Homo sapiens; identical to SEQ ID NO: 18863
  Payload ID: 3785
  Gene Symbol: CHCHD10
  Gene Name: coiled-coil-helix-coiled-coil-helix domain containing 10
  ENSP ID: ENSP00000486793

SEQ ID NO: 18868 - protein, 142 aa, Homo sapiens; identical to SEQ ID NO: 18862
  Payload ID: 3785
  Gene Symbol: CHCHD10
  Gene Name: coiled-coil-helix-coiled-coil-helix domain containing 10
  Uniprot ID: Q8WYQ3
  ENSP ID: ENSP00000487006

SEQ ID NO: 18869 - protein, 151 aa, Homo sapiens
  Payload ID: 3786
  Gene Symbol: CHCHD2
  Gene Name: coiled-coil-helix-coiled-coil-helix domain containing 2
  Uniprot ID: Q9Y6H1
  ENSP ID: ENSP00000378812
MPRGSRSRTSRMAPPASRAPQMRAAPRPAPVAQPPAAAPPSAVGSSAAAPRQPGLMAQMATTAAGVAVGSAVGHTLGHAITGGFSGGSNAEPARPDITYQEPQGTQPAQQQQPCLYEIKQFLECAQNQGDIKLCEGFNEVLKQCRLANGLA

SEQ ID NO: 18870 - protein, 227 aa, Homo sapiens
  Payload ID: 3787
  Gene Symbol: CHCHD3
  Gene Name: coiled-coil-helix-coiled-coil-helix domain containing 3
  Uniprot ID: Q9NX63
  ENSP ID: ENSP00000262570
MGGTTSTRRVTFEADENENITVVKGIRLSENVIDRMKESSPSGSKSQRYSGAYGASVSDEELKRRVAEELALEQAKKESEDQKRLKQAKELDRERAAANEQLTRAILRERICSEEERAKAKHLARQLEEKDRVLKKQDAFYKEQLARLEERSSEFYRVTTEQYQKAAEEVEAKFKRYESHPVCADLQAKILQCYRENTHQTLKCSALATQYMHCVNHAKQSMLEKGG

SEQ ID NO: 18871 - protein, 232 aa, Homo sapiens
  Payload ID: 3787
  Gene Symbol: CHCHD3
  Gene Name: coiled-coil-helix-coiled-coil-helix domain containing 3
  ENSP ID: ENSP00000389297
MGGTTSTRRVTFEADENENITVVKGIRLSENVIDRMKESSPSGSKSQRYSGAYGASVSDEELKRRVAEELALEQAKKESEDQKRLKQAKELDRERAAANEQLTRAILRERICSEEERAKAKHLVSIKNARQLEEKDRVLKKQDAFYKEQLARLEERSSEFYRVTTEQYQKAAEEVEAKFKRYESHPVCADLQAKILQCYRENTHQTLKCSALATQYMHCVNHAKQSMLEKGG

SEQ ID NO: 18872 - protein, 63 aa, Homo sapiens
  Payload ID: 3787
  Gene Symbol: CHCHD3
  Gene Name: coiled-coil-helix-coiled-coil-helix domain containing 3
  ENSP ID: ENSP00000403467
MGGTTSTRRVTFEADENENITVVKGIRLSENVIDRMKESSPSGSKSQRYSGAYGASVPLRTPT

SEQ ID NO: 18873 - protein, 241 aa, Homo sapiens
  Payload ID: 3787
  Gene Symbol: CHCHD3
  Gene Name: coiled-coil-helix-coiled-coil-helix domain containing 3
  ENSP ID: ENSP00000410425
MGGTTSTRRVTFEADENENITVVKGIRLSENVIDRMKESSPSGSKSQRYSGAYGASVSDEELKRRVAEELALEQAKKESEDQKREETSETALRKFCVQSFSSNFLESQNMYTLLLKQAKELDRERAAANEQLTRAILRERICSEEERAKAKHLARQLEEKDRVLKKQDAFYKEQLARLEERSSEFYRVTTEQYQKAAEEVEAKFKFGEMKYHKTGLFILLPLVPVWLLVGELVTSPSFQAT

SEQ ID NO: 18874 - protein, 155 aa, Homo sapiens
  Payload ID: 3788
  Gene Symbol: CHCHD4
  Gene Name: coiled-coil-helix-coiled-coil-helix domain containing 4
  Uniprot ID: Q8N4Q1
  ENSP ID: ENSP00000295767
MPVSYSSVTTRYYHRAGAEEGKDRIIFVTKEDHETPSSAELVADDPNDPYEEHGLILPNGNINWNCPCLGGMASGPCGEQFKSAFSCFHYSTEEIKGSDCVDQFRAMQECMQKYPDLYPQEDEDEEEEREKKPAEQAEETAPIEATATKEEEGSS

SEQ ID NO: 18875 - protein, 142 aa, Homo sapiens
  Payload ID: 3788
  Gene Symbol: CHCHD4
  Gene Name: coiled-coil-helix-coiled-coil-helix domain containing 4
  Uniprot ID: Q8N4Q1
  ENSP ID: ENSP00000380122
MSYCRQEGKDRIIFVTKEDHETPSSAELVADDPNDPYEEHGLILPNGNINWNCPCLGGMASGPCGEQFKSAFSCFHYSTEEIKGSDCVDQFRAMQECMQKYPDLYPQEDEDEEEEREKKPAEQAEETAPIEATATKEEEGSS

SEQ ID NO: 18876 - protein, 33 aa, Homo sapiens
  Payload ID: 3788
  Gene Symbol: CHCHD4
  Gene Name: coiled-coil-helix-coiled-coil-helix domain containing 4
  ENSP ID: ENSP00000402716
MSYCRQEGFAQDGSFWNVYSPPSLPEALCQGQR

SEQ ID NO: 18877 - protein, 110 aa, Homo sapiens
  Payload ID: 3789
  Gene Symbol: CHCHD5
  Gene Name: coiled-coil-helix-coiled-coil-helix domain containing 5
  Uniprot ID: Q9BSY4
  ENSP ID: ENSP00000325655
MQAALEVTARYCGRELEQYGQCVAAKPESWQRDCHYLKMSIAQCTSSHPIIRQIRQACAQPFEAFEECLRQNEAAVGNCAEHMRRFLQCAEQVQPPRSPATVEAQPLPAS

SEQ ID NO: 18878 - protein, 158 aa, Homo sapiens
  Payload ID: 3789
  Gene Symbol: CHCHD5
  Gene Name: coiled-coil-helix-coiled-coil-helix domain containing 5
  Uniprot ID: Q9BSY4
  ENSP ID: ENSP00000386994
MQAALEVTARYCGRELEQYGQCVAAKPESWQRDCHYLKMSIAQCTSSHPIIRQIRQACAQPFEAFEECLRQNEAAVGNCAEHMRRFLQCAEQVQPPRSPATVEVRGAHLSSSLFSITSPSSFWLFRVKTLESSSAPPHHHTGLCHASRIQNIITSCPI

SEQ ID NO: 18879 - protein, 48 aa, Homo sapiens
  Payload ID: 3789
  Gene Symbol: CHCHD5
  Gene Name: coiled-coil-helix-coiled-coil-helix domain containing 5
  ENSP ID: ENSP00000412731
MQAALEVTARYCGRELEQYGQCVAAKPESWQRDCHYLKMSIAQCTSSQ

SEQ ID NO: 18880 - protein, 235 aa, Homo sapiens
  Payload ID: 3790
  Gene Symbol: CHCHD6
  Gene Name: coiled-coil-helix-coiled-coil-helix domain containing 6
  Uniprot ID: Q9BRQ6
  ENSP ID: ENSP00000290913
MGSTESSEGRRVSFGVDEEERVRVLQGVRLSENVVNRMKEPSSPPPAPTSSTFGLQDGNLRAPHKESTLPRSGSSGGQQPSGMKEGVKRYEQEHAAIQDKLFQVAKREREAATKHSKASLPTGEGSISHEEQKSVRLARELESREAELRRRDTFYKEQLERIERKNAEMYKLSSEQFHEAASKMESTIKPRRVEPVCSGLQAQILHCYRDRPHEVLLCSDLVKAYQRCVSAAHKG

SEQ ID NO: 18881 - protein, 166 aa, Homo sapiens
  Payload ID: 3790
  Gene Symbol: CHCHD6
  Gene Name: coiled-coil-helix-coiled-coil-helix domain containing 6
  ENSP ID: ENSP00000422787
  MOD_RES (1)..(1): Any amino acid
XTLPRSGSSGGQQPSGMKEGVKRYEQEHAAIQDKLFQVAKREREAATKHSKASLPTGEGSISHEEQKSVRLARELESREAELRRRDTFYKEQLERIERKNAEMYKLSSEQFHEAASKMESTIKVEPVCSGLQAQILHCYRDRPHEVLLCSDLVKAYQRCVSAAHKG

SEQ ID NO: 18882 - protein, 256 aa, Homo sapiens
  Payload ID: 3790
  Gene Symbol: CHCHD6
  Gene Name: coiled-coil-helix-coiled-coil-helix domain containing 6
  ENSP ID: ENSP00000422912
MGSTESSEGRRVSFGVDEEERVRVLQGVRLSENVVNRMKEPSSPPPAPTSSTFGLQDGNLRAPHKESTLPRSGSSGGQQPSGMKEGVKRYEQEHAAIQDKLFQVAKREREAATKHSKASLPTGEGSISHEEQKSVRLQARELESREAELRRRDTFYKEQLERIERKNAEMYKLSSEQFHEAASKMESTIKPRRVEPVCSGLQAQILHCYRDRPHEVLLCSDLVKAYQRCVSAAHKVRPCLPPRFPRALGGRRGTSI

SEQ ID NO: 18883 - protein, 140 aa, Homo sapiens
  Payload ID: 3790
  Gene Symbol: CHCHD6
  Gene Name: coiled-coil-helix-coiled-coil-helix domain containing 6
  ENSP ID: ENSP00000427517
MGSTESSEGRRVSFGVDEEERVRVLQGVRLSENVVNRMKEPSSPPPAPTSSTFGLQDGNLRAPHKESTLPRSGSSGGQQPSGMKEGVKRYEQEHAAIQDKLFQVAKREREAATKHSKASLPTGEGSISHEEQKSVRLIIH

SEQ ID NO: 18884 - protein, 110 aa, Homo sapiens
  Payload ID: 3791
  Gene Symbol: CHCHD7
  Gene Name: coiled-coil-helix-coiled-coil-helix domain containing 7
  Uniprot ID: Q9BUK0
  ENSP ID: ENSP00000306425
MKCEETHAPNSNWVYVMLPSKKTVRMPSVTQRLRDPDINPCLSESDASTRCLDENNYDRERCSTYFLRYKNCRRFWNSIVMQRRKNGVKPFMPTAAERDEILRAVGNMPY

SEQ ID NO: 18885 - protein, 85 aa, Homo sapiens
  Payload ID: 3791
  Gene Symbol: CHCHD7
  Gene Name: coiled-coil-helix-coiled-coil-helix domain containing 7
  Uniprot ID: Q9BUK0
  ENSP ID: ENSP00000347469
MPSVTQRLRDPDINPCLSESDASTRCLDENNYDRERCSTYFLRYKNCRRFWNSIVMQRRKNGVKPFMPTAAERDEILRAVGNMPY

SEQ ID NO: 18886 - protein, 94 aa, Homo sapiens
  Payload ID: 3791
  Gene Symbol: CHCHD7
  Gene Name: coiled-coil-helix-coiled-coil-helix domain containing 7
  ENSP ID: ENSP00000379949
MLPSKKTVRMPSVTQRLRDPDINPCLSESDASTRCLDENNYDRERCSTYFLRYKNCRRFWNSIVMQRRKNGVKPFMPTAAERDEILRAVGNMPY

SEQ ID NO: 18887 - protein, 56 aa, Homo sapiens
  Payload ID: 3791
  Gene Symbol: CHCHD7
  Gene Name: coiled-coil-helix-coiled-coil-helix domain containing 7
  Uniprot ID: Q9BUK0
  ENSP ID: ENSP00000428095
MPSVTQRLRDPDINPCLSILFYLLNDASLISVRNLMLPPDVWMKITMTGKGVPLTS

SEQ ID NO: 18888 - protein, 68 aa, Homo sapiens
  Payload ID: 3791
  Gene Symbol: CHCHD7
  Gene Name: coiled-coil-helix-coiled-coil-helix domain containing 7
  Uniprot ID: Q9BUK0
  ENSP ID: ENSP00000428274
MHQTRTGKKTVRMPSVTQRLRDPDINPCLSILFYLLNDASLISVRNLMLPPDVWMKITMTGKGVPLTS

SEQ ID NO: 18889 - protein, 97 aa, Homo sapiens
  Payload ID: 3791
  Gene Symbol: CHCHD7
  Gene Name: coiled-coil-helix-coiled-coil-helix domain containing 7
  Uniprot ID: Q9BUK0
  ENSP ID: ENSP00000428917
MHQTRTGKKTVRMPSVTQRLRDPDINPCLSESDASTRCLDENNYDRERCSTYFLRYKNCRRFWNSIVMQRRKNGVKPFMPTAAERDEILRAVGNMPY

SEQ ID NO: 18890 - protein, 65 aa, Homo sapiens
  Payload ID: 3791
  Gene Symbol: CHCHD7
  Gene Name: coiled-coil-helix-coiled-coil-helix domain containing 7
  ENSP ID: ENSP00000429217
MLPSKKTVRMPSVTQRLRDPDINPCLSILFYLLNDASLISVRNLMLPPDVWMKITMTGKGVPLTS

SEQ ID NO: 18891 - protein, 44 aa, Homo sapiens
  Payload ID: 3791
  Gene Symbol: CHCHD7
  Gene Name: coiled-coil-helix-coiled-coil-helix domain containing 7
  ENSP ID: ENSP00000429230
MPSVTQRLRDPDINPCLSESDASTRCLDENNYDRERCSTYFLRY

SEQ ID NO: 18892 - protein, 56 aa, Homo sapiens; identical to SEQ ID NO: 18887
  Payload ID: 3791
  Gene Symbol: CHCHD7
  Gene Name: coiled-coil-helix-coiled-coil-helix domain containing 7
  Uniprot ID: Q9BUK0
  ENSP ID: ENSP00000429635

SEQ ID NO: 18893 - protein, 60 aa, Homo sapiens
  Payload ID: 3791
  Gene Symbol: CHCHD7
  Gene Name: coiled-coil-helix-coiled-coil-helix domain containing 7
  ENSP ID: ENSP00000430350
MPSVTQRLRDPDINPCLSESDASTRCLDENNYDRERCSTYFLRYKNCRRFWVSLDWLALC

SEQ ID NO: 18894 - protein, 68 aa, Homo sapiens; identical to SEQ ID NO: 18888
  Payload ID: 3791
  Gene Symbol: CHCHD7
  Gene Name: coiled-coil-helix-coiled-coil-helix domain containing 7
  Uniprot ID: Q9BUK0
  ENSP ID: ENSP00000430458

SEQ ID NO: 18895 - protein, 65 aa, Homo sapiens; identical to SEQ ID NO: 18890
  Payload ID: 3791
  Gene Symbol: CHCHD7
  Gene Name: coiled-coil-helix-coiled-coil-helix domain containing 7
  ENSP ID: ENSP00000430498

SEQ ID NO: 18896 - protein, 61 aa, Homo sapiens
  Payload ID: 3791
  Gene Symbol: CHCHD7
  Gene Name: coiled-coil-helix-coiled-coil-helix domain containing 7
  ENSP ID: ENSP00000430714
MLPSKKTVRMPSVTQRLRDPDINPCLSESDASTRCLDENNYDRERCSTYFLRYKNCRRFWP

SEQ ID NO: 18897 - protein, 46 aa, Homo sapiens
  Payload ID: 3791
  Gene Symbol: CHCHD7
  Gene Name: coiled-coil-helix-coiled-coil-helix domain containing 7
  ENSP ID: ENSP00000430882
MPSVTQRLRDPDINPCLSESDASTRCLDENNYDRERCSTYFLRILS

SEQ ID NO: 18898 - protein, 576 aa, Homo sapiens
  Payload ID: 3792
  Gene Symbol: COIL
  Gene Name: coilin
  Uniprot ID: P38432
  ENSP ID: ENSP00000240316
MAASETVRLRLQFDYPPPATPHCTAFWLLVDLNRCRVVTDLISLIRQRFGFSSGAFLGLYLEGGLLPPAESARLVRDNDCLRVKLEERGVAENSVVISNGDINLSLRKAKKRAFQLEEGEETEPDCKYSKKHWKSRENNNNNEKVLDLEPKAVTDQTVSKKNKRKNKATCGTVGDDNEEAKRKSPKKKEKCEYKKKAKNPKSPKVQAVKDWANQRCSSPKGSARNSLVKAKRKGSVSVCSKESPSSSSESESCDESISDGPSKVTLEARNSSEKLPTELSKEEPSTKNTTADKLAIKLGFSLTPSKGKTSGTTSSSSDSSAESDDQCLMSSSTPECAAGFLKTVGLFAGRGRPGPGLSSQTAGAAGWRRSGSNGGGQAPGASPSVSLPASLGRGWGREENLFSWKGAKGRGMRGRGRGRGHPVSCVVNRSTDNQRQQQLNDVVKNSSTIIQNPVETPKKDYSLLPLLAAAPQVGEKIAFKLLELTSSYSPDVSDYKEGRILSHNPETQQVDIEILSSLPALREPGKFDLVYHNENGAEVVEYAVTQESKITVFWKELIDPRLIIESPSNTSSTEPA

SEQ ID NO: 18899 - protein, 37 aa, Homo sapiens
  Payload ID: 3792
  Gene Symbol: COIL
  Gene Name: coilin
  ENSP ID: ENSP00000460217
MDNQHYHLLGVKLEERGVAENSVVISNGDINLSLRKA

SEQ ID NO: 18900 - protein, 172 aa, Homo sapiens
  Payload ID: 3793
  Gene Symbol: CIRBP
  Gene Name: cold inducible RNA binding protein
  Uniprot ID: Q14011
  ENSP ID: ENSP00000322887
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYATHNE

SEQ ID NO: 18901 - protein, 58 aa, Homo sapiens
  Payload ID: 3793
  Gene Symbol: CIRBP
  Gene Name: cold inducible RNA binding protein
  ENSP ID: ENSP00000407512
RSQSGGYSDRSSGGSYRDSYDSYEAGQRAEARGIPGRPQTASRLASSAVASRVLSILC

SEQ ID NO: 18902 - protein, 263 aa, Homo sapiens
  Payload ID: 3793
  Gene Symbol: CIRBP
  Gene Name: cold inducible RNA binding protein
  Uniprot ID: Q14011
  ENSP ID: ENSP00000412831
MASDEGKLFVGGLSFDTNEQSLEQVFSKYGQISEVVVVKDRETQRSRGFGFVTFENIDDAKDAMMAMNGKSVDGRQIRVDQAGGGDRGYGGNRFESRSGGYGGSRDYYSSRSQSGGYSDRSSGGSYRDSYDSYGKSHSEGATLLWPAVGARFTLVPSPSTLGWTLRPCHCACPEEAHLSSQSHFYRRTQKPNETDQKGKGERGPAGQSARCMCGRRPASLGCGGWLLPGRRPRPGLASGVKLPLVASVPLHCACFLSSATHNE

SEQ ID NO: 18903 - protein, 60 aa, Homo sapiens
  Payload ID: 3793
  Gene Symbol: CIRBP
  Gene Name: cold inducible RNA binding protein
  ENSP ID: ENSP00000464728
MASDEGKLFVGGLSFDTNEQSLEQVFSKYGQISEDLSPLHSGGCERQGDPEISGIWVCHL

SEQ ID NO: 18904 - protein, 79 aa, Homo sapiens
  Payload ID: 3793
  Gene Symbol: CIRBP
  Gene Name: cold inducible RNA binding protein
  ENSP ID: ENSP00000464830
MASDEGKLFVGGLSFDTNEQSLEQVFSKYGQISEVCRWTADPSRPGRQVVRQPIPWVPWWLCRGPGLLPWGPRTGPWVL

SEQ ID NO: 18905 - protein, 168 aa, Homo sapiens
  Payload ID: 3793
  Gene Symbol: CIRBP
  Gene Name: cold inducible RNA binding protein
  ENSP ID: ENSP00000464906
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYG

SEQ ID NO: 18906 - protein, 297 aa, Homo sapiens
  Payload ID: 3793
  Gene Symbol: CIRBP
  Gene Name: cold inducible RNA binding protein
  ENSP ID: ENSP00000465077
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYGKSHSEGATLLWPAVGARFTLVPSPSTLGWTLRPCHCACPEEAHLSSQSHFYRRTQKPNETDQKGKGERGPAGQSARCMCGRRPASLGCGGWLLPGRRPRPGLASGVKLPLVASVPLHCACFLSSATHNE

SEQ ID NO: 18907 - protein, 79 aa, Homo sapiens; identical to SEQ ID NO: 18904
  Payload ID: 3793
  Gene Symbol: CIRBP
  Gene Name: cold inducible RNA binding protein
  ENSP ID: ENSP00000465114

SEQ ID NO: 18908 - protein, 148 aa, Homo sapiens
  Payload ID: 3793
  Gene Symbol: CIRBP
  Gene Name: cold inducible RNA binding protein
  ENSP ID: ENSP00000465334
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQS

SEQ ID NO: 18909 - protein, 105 aa, Homo sapiens
  Payload ID: 3793
  Gene Symbol: CIRBP
  Gene Name: cold inducible RNA binding protein
  ENSP ID: ENSP00000465338
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFR

SEQ ID NO: 18910 - protein, 297 aa, Homo sapiens; identical to SEQ ID NO: 18906
  Payload ID: 3793
  Gene Symbol: CIRBP
  Gene Name: cold inducible RNA binding protein
  ENSP ID: ENSP00000465558

SEQ ID NO: 18911 - protein, 172 aa, Homo sapiens; identical to SEQ ID NO: 18900
  Payload ID: 3793
  Gene Symbol: CIRBP
  Gene Name: cold inducible RNA binding protein
  Uniprot ID: Q14011
  ENSP ID: ENSP00000465779

SEQ ID NO: 18912 - protein, 297 aa, Homo sapiens; identical to SEQ ID NO: 18906
  Payload ID: 3793
  Gene Symbol: CIRBP
  Gene Name: cold inducible RNA binding protein
  ENSP ID: ENSP00000466025

SEQ ID NO: 18913 - protein, 172 aa, Homo sapiens; identical to SEQ ID NO: 18900
  Payload ID: 3793
  Gene Symbol: CIRBP
  Gene Name: cold inducible RNA binding protein
  Uniprot ID: Q14011
  ENSP ID: ENSP00000466110

SEQ ID NO: 18914 - protein, 73 aa, Homo sapiens
  Payload ID: 3793
  Gene Symbol: CIRBP
  Gene Name: cold inducible RNA binding protein
  ENSP ID: ENSP00000466131
  MOD_RES (1)..(1): Any amino acid
XLKEEGTEAMGGTGSSPGVGATEAPETTIAAGVRVVATVTGARAGPTETVMTVTPMEAAALGGQKCCAPNRTL

SEQ ID NO: 18915 - protein, 172 aa, Homo sapiens; identical to SEQ ID NO: 18900
  Payload ID: 3793
  Gene Symbol: CIRBP
  Gene Name: cold inducible RNA binding protein
  Uniprot ID: Q14011
  ENSP ID: ENSP00000466207

SEQ ID NO: 18916 - protein, 135 aa, Homo sapiens
  Payload ID: 3793
  Gene Symbol: CIRBP
  Gene Name: cold inducible RNA binding protein
  ENSP ID: ENSP00000466216
MASDEGKLFVGGLSFDTNEQSLEQVFSKYGQISEVVVVKDRETQRSRGFGFVTFENIDDAKDAMMAMNGKVRIRVLSRSPVSRMGHPPANPSRPLSPVCRWTADPSRPGRRRGPRLWGEPVRVQEWGLRRLQRLL

SEQ ID NO: 18917 - protein, 89 aa, Homo sapiens
  Payload ID: 3793
  Gene Symbol: CIRBP
  Gene Name: cold inducible RNA binding protein
  ENSP ID: ENSP00000466238
DEGKLFVGGLSFDTNEQSLEQVFSKYGQISEVVVVKDRETQRSRGFGFVTFENIDDAKDAMMAMNGKSVDGRQIRVDQPLRPSVLCAPQ

SEQ ID NO: 18918 - protein, 159 aa, Homo sapiens
  Payload ID: 3793
  Gene Symbol: CIRBP
  Gene Name: cold inducible RNA binding protein
  ENSP ID: ENSP00000466712
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGS

SEQ ID NO: 18919 - protein, 297 aa, Homo sapiens; identical to SEQ ID NO: 18906
  Payload ID: 3793
  Gene Symbol: CIRBP
  Gene Name: cold inducible RNA binding protein
  ENSP ID: ENSP00000466897

SEQ ID NO: 18920 - protein, 38 aa, Homo sapiens
  Payload ID: 3793
  Gene Symbol: CIRBP
  Gene Name: cold inducible RNA binding protein
  ENSP ID: ENSP00000467028
MASDEGKLFVGGLSFDTNEQSLEQVFSKYGQISEVVVV

SEQ ID NO: 18921 - protein, 80 aa, Homo sapiens
  Payload ID: 3793
  Gene Symbol: CIRBP
  Gene Name: cold inducible RNA binding protein
  ENSP ID: ENSP00000467138
MASDEGKLFVGGLSFDTNEQSLEQVFSKYGQISEVVVVKDRETQRSRGFGFVTFENIDDAKDAMMAMNGKSVDGRQIRVD

SEQ ID NO: 18922 - protein, 135 aa, Homo sapiens; identical to SEQ ID NO: 18916
  Payload ID: 3793
  Gene Symbol: CIRBP
  Gene Name: cold inducible RNA binding protein
  ENSP ID: ENSP00000467307

SEQ ID NO: 18923 - protein, 168 aa, Homo sapiens; identical to SEQ ID NO: 18905
  Payload ID: 3793
  Gene Symbol: CIRBP
  Gene Name: cold inducible RNA binding protein
  ENSP ID: ENSP00000467449

SEQ ID NO: 18924 - protein, 168 aa, Homo sapiens; identical to SEQ ID NO: 18905
  Payload ID: 3793
  Gene Symbol: CIRBP
  Gene Name: cold inducible RNA binding protein
  ENSP ID: ENSP00000467734

SEQ ID NO: 18925 - protein, 79 aa, Homo sapiens; identical to SEQ ID NO: 18904
  Payload ID: 3793
  Gene Symbol: CIRBP
  Gene Name: cold inducible RNA binding protein
  ENSP ID: ENSP00000467791

SEQ ID NO: 18926 - protein, 168 aa, Homo sapiens; identical to SEQ ID NO: 18905
  Payload ID: 3793
  Gene Symbol: CIRBP
  Gene Name: cold inducible RNA binding protein
  ENSP ID: ENSP00000467848

SEQ ID NO: 18927 - protein, 79 aa, Homo sapiens; identical to SEQ ID NO: 18904
  Payload ID: 3793
  Gene Symbol: CIRBP
  Gene Name: cold inducible RNA binding protein
  ENSP ID: ENSP00000467876

SEQ ID NO: 18928 - protein, 202 aa, Homo sapiens
  Payload ID: 3793
  Gene Symbol: CIRBP
  Gene Name: cold inducible RNA binding protein
  ENSP ID: ENSP00000467948
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYEAGQRAEARGIPGRPQTASRLASSAVASRVLSILC

SEQ ID NO: 18929 - protein, 32 aa, Homo sapiens
  Payload ID: 3793
  Gene Symbol: CIRBP
  Gene Name: cold inducible RNA binding protein
  ENSP ID: ENSP00000468016
MASDEGKLFVGGLSFDTNEQSLEQVFSKYGQI

SEQ ID NO: 18930 - protein, 173 aa, Homo sapiens
  Payload ID: 3793
  Gene Symbol: CIRBP
  Gene Name: cold inducible RNA binding protein
  ENSP ID: ENSP00000468097
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGECHEWVPWGCCEVLLVGAGTHFFLYVQEEGTEAMGGTGSSPGVGATEAPETTIAGE

SEQ ID NO: 18931 - protein, 60 aa, Homo sapiens; identical to SEQ ID NO: 18903
  Payload ID: 3793
  Gene Symbol: CIRBP
  Gene Name: cold inducible RNA binding protein
  ENSP ID: ENSP00000468229

SEQ ID NO: 18932 - protein, 168 aa, Homo sapiens; identical to SEQ ID NO: 18905
  Payload ID: 3793
  Gene Symbol: CIRBP
  Gene Name: cold inducible RNA binding protein
  ENSP ID: ENSP00000468645

SEQ ID NO: 18933 - protein, 172 aa, Homo sapiens; identical to SEQ ID NO: 18900
  Payload ID: 3793
  Gene Symbol: CIRBP
  Gene Name: cold inducible RNA binding protein
  Uniprot ID: Q14011
  ENSP ID: ENSP00000468788

SEQ ID NO: 18934 - protein, 297 aa, Homo sapiens; identical to SEQ ID NO: 18906
  Payload ID: 3793
  Gene Symbol: CIRBP
  Gene Name: cold inducible RNA binding protein
  ENSP ID: ENSP00000486590

SEQ ID NO: 18935 - protein, 153 aa, Homo sapiens
  Payload ID: 3794
  Gene Symbol: CSDC2
  Gene Name: cold shock domain containing C2, RNA binding
  Uniprot ID: Q9Y534
  ENSP ID: ENSP00000302485
MTSESTSPPVVPPLHSPKSPVWPTFPFHREGSRVWERGGVPPRDLPSPLPTKRTRTYSATARASAGPVFKGVCKQFSRSQGHGFITPENGSEDIFVHVSDIEGEYVPVEGDEVTYKMCPIPPKNQKFQAVEVVLTQLAPHTPHETWSGQVVGS

SEQ ID NO: 18936 - protein, 151 aa, Homo sapiens
  Payload ID: 3794
  Gene Symbol: CSDC2
  Gene Name: cold shock domain containing C2, RNA binding
  ENSP ID: ENSP00000417127
KSPVWPTFPFHREGSRVWERGGVPPRDLPSPLPTKRTRTYSATARASAGPVFKGVCKQFSRSQGHGFITPENGSEDIFVHVSEPRPNSSEVTTHRCGPRSRLMSCLWEENLPASLHRVLRRHHAVANSPGVGKDLKVVPTLHTEDGQRRDI

SEQ ID NO: 18937 - protein, 767 aa, Homo sapiens
  Payload ID: 3795
  Gene Symbol: CSDE1
  Gene Name: cold shock domain containing E1, RNA-binding
  Uniprot ID: O75534
  ENSP ID: ENSP00000261443
MSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 18938 - protein, 767 aa, Homo sapiens; identical to SEQ ID NO: 18937
  Payload ID: 3795
  Gene Symbol: CSDE1
  Gene Name: cold shock domain containing E1, RNA-binding
  Uniprot ID: O75534
  ENSP ID: ENSP00000342408

SEQ ID NO: 18939 - protein, 798 aa, Homo sapiens
  Payload ID: 3795
  Gene Symbol: CSDE1
  Gene Name: cold shock domain containing E1, RNA-binding
  Uniprot ID: O75534
  ENSP ID: ENSP00000351329
MSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQVVCAVPHNLESKSPAAPGQSPTGSVCYERNGEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 18940 - protein, 813 aa, Homo sapiens
  Payload ID: 3795
  Gene Symbol: CSDE1
  Gene Name: cold shock domain containing E1, RNA-binding
  Uniprot ID: O75534
  ENSP ID: ENSP00000358543
MENVFTVSSDPHPSPAAPPSLSLPLSSSSTSSGTKKQKRTPTYQRSMSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 18941 - protein, 844 aa, Homo sapiens
  Payload ID: 3795
  Gene Symbol: CSDE1
  Gene Name: cold shock domain containing E1, RNA-binding
  Uniprot ID: O75534
  ENSP ID: ENSP00000407724
MENVFTVSSDPHPSPAAPPSLSLPLSSSSTSSGTKKQKRTPTYQRSMSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQVVCAVPHNLESKSPAAPGQSPTGSVCYERNGEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 18942 - protein, 668 aa, Homo sapiens
  Payload ID: 3795
  Gene Symbol: CSDE1
  Gene Name: cold shock domain containing E1, RNA-binding
  ENSP ID: ENSP00000431297
MNGQEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 18943 - protein, 46 aa, Homo sapiens
  Payload ID: 3795
  Gene Symbol: CSDE1
  Gene Name: cold shock domain containing E1, RNA-binding
  ENSP ID: ENSP00000431562
MSFDPNLLHNNGHNGYPNGTSAALRETGVIEKLLTSYGFIQCSERQ

SEQ ID NO: 18944 - protein, 36 aa, Homo sapiens
  Payload ID: 3795
  Gene Symbol: CSDE1
  Gene Name: cold shock domain containing E1, RNA-binding
  ENSP ID: ENSP00000431770
MNGQEVFYLTYTPEDVEGNVQLETGDKINFVIDNNK

SEQ ID NO: 18945 - protein, 7 aa, Homo sapiens
  Payload ID: 3795
  Gene Symbol: CSDE1
  Gene Name: cold shock domain containing E1, RNA-binding
  ENSP ID: ENSP00000432805
MSFDPNL

SEQ ID NO: 18946 - protein, 798 aa, Homo sapiens; identical to SEQ ID NO: 18939
  Payload ID: 3795
  Gene Symbol: CSDE1
  Gene Name: cold shock domain containing E1, RNA-binding
  Uniprot ID: O75534
  ENSP ID: ENSP00000432958

SEQ ID NO: 18947 - protein, 94 aa, Homo sapiens
  Payload ID: 3795
  Gene Symbol: CSDE1
  Gene Name: cold shock domain containing E1, RNA-binding
  ENSP ID: ENSP00000435185
MSFDPNLLHNNGHNGYPNGTSAALRETGVIEKLLTSYGFIQCSERQARLFFHCSQYNGNLQDLKVGDDVEFEVSSDRRTGKPIAVKLVKIKQEI

SEQ ID NO: 18948 - protein, 136 aa, Homo sapiens
  Payload ID: 3795
  Gene Symbol: CSDE1
  Gene Name: cold shock domain containing E1, RNA-binding
  ENSP ID: ENSP00000437159
MNGQEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGT

SEQ ID NO: 18949 - protein, 844 aa, Homo sapiens; identical to SEQ ID NO: 18941
  Payload ID: 3795
  Gene Symbol: CSDE1
  Gene Name: cold shock domain containing E1, RNA-binding
  Uniprot ID: O75534
  ENSP ID: ENSP00000481762

SEQ ID NO: 18950 - protein, 112 aa, Homo sapiens
  Payload ID: 3796
  Gene Symbol: CLPS
  Gene Name: colipase, pancreatic
  Uniprot ID: P04118
  ENSP ID: ENSP00000259938
MEKILILLLVALSVAYAAPGPRGIIINLENGELCMNSAQCKSNCCQHSSALGLARCTSMASENSECSVKTLYGIYYKCPCERGLTCEGDKTIVGSITNTNFGICHDAGRSKQ

SEQ ID NO: 18951 - protein, 98 aa, Homo sapiens
  Payload ID: 3796
  Gene Symbol: CLPS
  Gene Name: colipase, pancreatic
  ENSP ID: ENSP00000482919
MILLPQPPKKLGLQENGELCMNSAQCKSNCCQHSSALGLARCTSMASENSECSVKTLYGIYYKCPCERGLTCEGDKTIVGSITNTNFGICHDAGRSKQ

SEQ ID NO: 18952 - protein, 71 aa, Homo sapiens
  Payload ID: 3796
  Gene Symbol: CLPS
  Gene Name: colipase, pancreatic
  ENSP ID: ENSP00000483589
MEKILILLLVALSVAYAAPGPRGIIINLTLYGIYYKCPCERGLTCEGDKTIVGSITNTNFGICHDAGRSKQ

SEQ ID NO: 18953 - protein, 121 aa, Homo sapiens
  Payload ID: 3797
  Gene Symbol: CLPSL1
  Gene Name: colipase-like 1
  Uniprot ID: A2RUU4
  ENSP ID: ENSP00000362968
MMLPQWLLLLFLLFFFLFLLTRGSLSPTKYNLLELKESCIRNQDCETGCCQRAPDNCESHCAEKGSEGSLCQTQVFFGQYRACPCLRNLTCIYSKNEKWLSIAYGRCQKIGRQKLAKKMFF

SEQ ID NO: 18954 - protein, 42 aa, Homo sapiens
  Payload ID: 3797
  Gene Symbol: CLPSL1
  Gene Name: colipase-like 1
  ENSP ID: ENSP00000396556
GCCQRAPDNCESHCAEKGSEGSLCQTQLPATPCFLPSNTVRT

SEQ ID NO: 18955 - protein, 153 aa, Homo sapiens
  Payload ID: 3798
  Gene Symbol: CLPSL2
  Gene Name: colipase-like 2
  Uniprot ID: Q6UWE3
  ENSP ID: ENSP00000353639
MAAALALVAGVLSGAVLPLWSALPQYKKKITDRCFHHSECYSGCCLMDLDSGGAFCAPRARITMICLPQWLELFKGRDRIIFIYEAPTPSLVSAHNQGSYQHHLPLPDGLDVHIQGLDVFPPVPYDLEEDAGWSLLPWGHRPWLPPTCSKSSS

SEQ ID NO: 18956 - protein, 100 aa, Homo sapiens
  Payload ID: 3798
  Gene Symbol: CLPSL2
  Gene Name: colipase-like 2
  Uniprot ID: Q6UWE3
  ENSP ID: ENSP00000385898
MAAALALVAGVLSGAVLPLWSALPQYKKKITDRCFHHSECYSGCCLMDLDSGGAFCAPRARITMICLPQTKGATNIICPCRMGLTCISKDLMCSRRCHMI

SEQ ID NO: 18957 - protein, 336 aa, Homo sapiens
  Payload ID: 3799
  Gene Symbol: CCBE1
  Gene Name: collagen and calcium binding EGF domains 1
  ENSP ID: ENSP00000381241
RKKCCKGYKFVLGQCIPEDYDVCAEAPCEQQCTDNFGRVLCTCYPGYRYDRERHRKREKPYCLDIDECASSNGTLCAHICINTLGSYRCECREGYIREDDGKTCTRGDKYPNDTGHEKSENMVKAGTCCATCKEFYQMKQTVLQLKQKIALLPNNAADLGKYITGDKVLASNTYLPGPPGLPGGQGPPGSPGPKGSPGFPGMPGPPGQPGPRGSMGPMGPSPDLSHIKQGRRGPVGPPGAPGRDGSKGERGAPGPRGSPGPPGSFDFLLLMLADIRNDITELQEKVFGHRTHSSAEEFPLPQEFPSYPEAMDLGSGDDHPRRTETRDLRAPRDFYP

SEQ ID NO: 18958 - protein, 406 aa, Homo sapiens
  Payload ID: 3799
  Gene Symbol: CCBE1
  Gene Name: collagen and calcium binding EGF domains 1
  Uniprot ID: Q6UXH8
  ENSP ID: ENSP00000404464
MVPPPPSRGGAARGQLGRSLGPLLLLLALGHTWTYREEPEDGDREICSESKIATTKYPCLKSSGELTTCYRKKCCKGYKFVLGQCIPEDYDVCAEAPCEQQCTDNFGRVLCTCYPGYRYDRERHRKREKPYCLDIDECASSNGTLCAHICINTLGSYRCECREGYIREDDGKTCTRGDKYPNDTGHEKSENMVKAGTCCATCKEFYQMKQTVLQLKQKIALLPNNAADLGKYITGDKVLASNTYLPGPPGLPGGQGPPGSPGPKGSPGFPGMPGPPGQPGPRGSMGPMGPSPDLSHIKQGRRGPVGPPGAPGRDGSKGERGAPGPRGSPGPPGSFDFLLLMLADIRNDITELQEKVFGHRTHSSAEEFPLPQEFPSYPEAMDLGSGDDHPRRTETRDLRAPRDFYP

SEQ ID NO: 18959 - protein, 46 aa, Homo sapiens
  Payload ID: 3799
  Gene Symbol: CCBE1
  Gene Name: collagen and calcium binding EGF domains 1
  ENSP ID: ENSP00000467710
MVKAGTCCATCKEFYQMKQTVLQLKQKIALLPNNAADLGKYITGDK

SEQ ID NO: 18960 - protein, 622 aa, Homo sapiens
  Payload ID: 3800
  Gene Symbol: COLGALT1
  Gene Name: collagen beta(1-O)galactosyltransferase 1
  Uniprot ID: Q8NBJ5
  ENSP ID: ENSP00000252599
MAAAPRAGRRRGQPLLALLLLLLAPLPPGAPPGADAYFPEERWSPESPLQAPRVLIALLARNAAHALPTTLGALERLRHPRERTALWVATDHNMDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAVPMVHSTFLIDLRKAASRNLAFYPPHPDYTWSFDDIIVFAFSCKQAEVQMYVCNKEEYGFLPVPLRAHSTLQDEAESFMHVQLEVMVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTLAYVISLQGARKLLAAEPLSKMLPVDEFLPVMFDKHPVSEYKAHFSLRNLHAFSVEPLLIYPTHYTGDDGYVSDTETSVVWNNEHVKTDWDRAKSQKMREQQALSREAKNSDVLQSPLDSAARDEL

SEQ ID NO: 18961 - protein, 218 aa, Homo sapiens
  Payload ID: 3800
  Gene Symbol: COLGALT1
  Gene Name: collagen beta(1-O)galactosyltransferase 1
  ENSP ID: ENSP00000468947
  MOD_RES (1)..(1): Any amino acid
XKAASRNLAFYPPHPDYTWSFDDIIVFAFSCKQAVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTLAYV

SEQ ID NO: 18962 - protein, 138 aa, Homo sapiens
  Payload ID: 3800
  Gene Symbol: COLGALT1
  Gene Name: collagen beta(1-O)galactosyltransferase 1
  ENSP ID: ENSP00000469817
MDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAV

SEQ ID NO: 18963 - protein, 626 aa, Homo sapiens
  Payload ID: 3801
  Gene Symbol: COLGALT2
  Gene Name: collagen beta(1-O)galactosyltransferase 2
  Uniprot ID: Q8IYK4
  ENSP ID: ENSP00000354960
MAARPAATLAWSLLLLSSALLREGCRARFVAERDSEDDGEEPVVFPESPLQSPTVLVAVLARNAAHTLPHFLGCLERLDYPKSRMAIWAATDHNVDNTTEIFREWLKNVQRLYHYVEWRPMDEPESYPDEIGPKHWPTSRFAHVMKLRQAALRTAREKWSDYILFIDVDNFLTNPQTLNLLIAENKTIVAPMLESRGLYSNFWCGITPKGFYKRTPDYVQIREWKRTGCFPVPMVHSTFLIDLRKEASDKLTFYPPHQDYTWTFDDIIVFAFSSRQAGIQMYLCNREHYGYLPIPLKPHQTLQEDIENLIHVQIEAMIDRPPMEPSQYVSVVPKYPDKMGFDEIFMINLKRRKDRRDRMLRTLYEQEIEVKIVEAVDGKALNTSQLKALNIEMLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 18964 - protein, 363 aa, Homo sapiens
  Payload ID: 3801
  Gene Symbol: COLGALT2
  Gene Name: collagen beta(1-O)galactosyltransferase 2
  ENSP ID: ENSP00000356490
MFSDCWLCPSLGSSGIQMYLCNREHYGYLPIPLKPHQTLQEDIENLIHVQIEAMIDRPPMEPSQYVSVVPKYPDKMGFDEIFMINLKRRKDRRDRMLRTLYEQEIEVKIVEAVDGKALNTSQLKALNIEMLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 18965 - protein, 234 aa, Homo sapiens
  Payload ID: 3801
  Gene Symbol: COLGALT2
  Gene Name: collagen beta(1-O)galactosyltransferase 2
  ENSP ID: ENSP00000356491
MLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 18966 - protein, 243 aa, Homo sapiens
  Payload ID: 3802
  Gene Symbol: CTHRC1
  Gene Name: collagen triple helix repeat containing 1
  Uniprot ID: Q96CG8
  ENSP ID: ENSP00000330523
MRPQGPAASPQRLRGLLLLLLLQLPAPSSASEIPKGKQKAQLRQREVVDLYNGMCLQGPAGVPGRDGSPGANGIPGTPGIPGRDGFKGEKGECLRESFEESWTPNYKQCSWSSLNYGIDLGKIAECTFTKMRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 18967 - protein, 147 aa, Homo sapiens
  Payload ID: 3802
  Gene Symbol: CTHRC1
  Gene Name: collagen triple helix repeat containing 1
  ENSP ID: ENSP00000416045
MRPQGPAASPQRLRGLLLLLLLQLPAPSSASEIPKGKQKAQLRQREVVDLYNGMCLQGPAGVPGRDGSPGANGIPGTPGIPGRDGFKGEKGECLRESFEESWTPNYKQCSWSSLNYGIDLGKIAVSLNYFKIEARFKGFHILVLIFR

SEQ ID NO: 18968 - protein, 113 aa, Homo sapiens
  Payload ID: 3802
  Gene Symbol: CTHRC1
  Gene Name: collagen triple helix repeat containing 1
  ENSP ID: ENSP00000430399
MRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 18969 - protein, 229 aa, Homo sapiens
  Payload ID: 3802
  Gene Symbol: CTHRC1
  Gene Name: collagen triple helix repeat containing 1
  Uniprot ID: Q96CG8
  ENSP ID: ENSP00000430550
MWPPGRSITVKLREKTVSRKLEMNGPSAFQGLICGKYNGMCLQGPAGVPGRDGSPGANGIPGTPGIPGRDGFKGEKGECLRESFEESWTPNYKQCSWSSLNYGIDLGKIAECTFTKMRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 18970 - protein, 1464 aa, Homo sapiens
  Payload ID: 3803
  Gene Symbol: COL1A1
  Gene Name: collagen, type I, alpha 1
  Uniprot ID: P02452
  ENSP ID: ENSP00000225964
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPAGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLPIIDVAPLDVGAPDQEFGFDVGPVCFL

SEQ ID NO: 18971 - protein, 154 aa, Homo sapiens
  Payload ID: 3803
  Gene Symbol: COL1A1
  Gene Name: collagen, type I, alpha 1
  ENSP ID: ENSP00000460459
MRSRRAFKDLRKEERGEGREVKNPSVPLRPGGKVVKLGVAVTTDNAPLPPVPVPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPG

SEQ ID NO: 18972 - protein, 1366 aa, Homo sapiens
  Payload ID: 3804
  Gene Symbol: COL1A2
  Gene Name: collagen, type I, alpha 2
  Uniprot ID: P08123
  ENSP ID: ENSP00000297268
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 18973 - protein, 1364 aa, Homo sapiens
  Payload ID: 3804
  Gene Symbol: COL1A2
  Gene Name: collagen, type I, alpha 2
  ENSP ID: ENSP00000477719
MLSFVDTRTLLLLAVTLCLATCQFFETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 18974 - protein, 1418 aa, Homo sapiens
  Payload ID: 3805
  Gene Symbol: COL2A1
  Gene Name: collagen, type II, alpha 1
  Uniprot ID: P02458
  ENSP ID: ENSP00000338213
MIRLGAPQTLVLLTLLVAAVLRCQGQDVRQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 18975 - protein, 1487 aa, Homo sapiens
  Payload ID: 3805
  Gene Symbol: COL2A1
  Gene Name: collagen, type II, alpha 1
  Uniprot ID: P02458
  ENSP ID: ENSP00000369889
MIRLGAPQTLVLLTLLVAAVLRCQGQDVQEAGSCVQDGQRYNDKDVWKPEPCRICVCDTGTVLCDDIICEDVKDCLSPEIPFGECCPICPTDLATASGQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 18976 - protein, 1466 aa, Homo sapiens
  Payload ID: 3806
  Gene Symbol: COL3A1
  Gene Name: collagen, type III, alpha 1
  Uniprot ID: P02461
  ENSP ID: ENSP00000304408
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVHLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 18977 - protein, 1163 aa, Homo sapiens
  Payload ID: 3806
  Gene Symbol: COL3A1
  Gene Name: collagen, type III, alpha 1
  Uniprot ID: P02461
  ENSP ID: ENSP00000315243
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVHLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 18978 - protein, 90 aa, Homo sapiens
  Payload ID: 3806
  Gene Symbol: COL3A1
  Gene Name: collagen, type III, alpha 1
  ENSP ID: ENSP00000415346
  MOD_RES (1)..(1): Any amino acid
XRGAPGERGRPGLPGAAGARGNDGARGSDGQPGPPGPPGTAGFPGSPGAKGPPGINGSPGGKGEMGPAGIPGAPGLMGARGPPGPAGANG

SEQ ID NO: 18979 - protein, 1669 aa, Homo sapiens
  Payload ID: 3807
  Gene Symbol: COL4A1
  Gene Name: collagen, type IV, alpha 1
  Uniprot ID: P02462
  ENSP ID: ENSP00000364979
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 18980 - protein, 519 aa, Homo sapiens
  Payload ID: 3807
  Gene Symbol: COL4A1
  Gene Name: collagen, type IV, alpha 1
  ENSP ID: ENSP00000443348
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPLLFQIHK

SEQ ID NO: 18981 - protein, 223 aa, Homo sapiens
  Payload ID: 3807
  Gene Symbol: COL4A1
  Gene Name: collagen, type IV, alpha 1
  ENSP ID: ENSP00000478222
MQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRV

SEQ ID NO: 18982 - protein, 1712 aa, Homo sapiens
  Payload ID: 3808
  Gene Symbol: COL4A2
  Gene Name: collagen, type IV, alpha 2
  Uniprot ID: P08572
  ENSP ID: ENSP00000353654
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 18983 - protein, 105 aa, Homo sapiens
  Payload ID: 3808
  Gene Symbol: COL4A2
  Gene Name: collagen, type IV, alpha 2
  ENSP ID: ENSP00000383027
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDV

SEQ ID NO: 18984 - protein, 42 aa, Homo sapiens
  Payload ID: 3808
  Gene Symbol: COL4A2
  Gene Name: collagen, type IV, alpha 2
  ENSP ID: ENSP00000481492
  MOD_RES (1)..(1): Any amino acid
XGDPGQHGLPGFPGLKVRSNFIMKLARHSEASPGVPFLPFIS

SEQ ID NO: 18985 - protein, 156 aa, Homo sapiens
  Payload ID: 3809
  Gene Symbol: COL4A3
  Gene Name: collagen, type IV, alpha 3 (Goodpasture antigen)
  ENSP ID: ENSP00000302781
GNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPVPAAPSL

SEQ ID NO: 18986 - protein, 1670 aa, Homo sapiens
  Payload ID: 3809
  Gene Symbol: COL4A3
  Gene Name: collagen, type IV, alpha 3 (Goodpasture antigen)
  Uniprot ID: Q01955
  ENSP ID: ENSP00000379823
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTLGYPGIPGAAGLKGQKGAPAKEEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 18987 - protein, 598 aa, Homo sapiens
  Payload ID: 3810
  Gene Symbol: COL4A3BP
  Gene Name: collagen, type IV, alpha 3 (Goodpasture antigen) binding protein
  Uniprot ID: Q9Y5P4
  ENSP ID: ENSP00000261415
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 18988 - protein, 234 aa, Homo sapiens
  Payload ID: 3810
  Gene Symbol: COL4A3BP
  Gene Name: collagen, type IV, alpha 3 (Goodpasture antigen) binding protein
  ENSP ID: ENSP00000350046
  MOD_RES (1)..(1): Any amino acid
XRFVQKVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 18989 - protein, 752 aa, Homo sapiens
  Payload ID: 3810
  Gene Symbol: COL4A3BP
  Gene Name: collagen, type IV, alpha 3 (Goodpasture antigen) binding protein
  Uniprot ID: Q9Y5P4
  ENSP ID: ENSP00000369862
MQHSCIPTPPSPFSAPPAFLPVVTRESRRGLSSGGSAGRNAGVTATAAAADGWKGRLPSPLVLLPRSARCQARRRRGGRTSSLLLLPPTPERALFASPSPDPSPRGLGASSGAAEGAGAGLLLGCRASMSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKPYSRSSSMSSIDLVSASDDVHRFSSQVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 18990 - protein, 624 aa, Homo sapiens
  Payload ID: 3810
  Gene Symbol: COL4A3BP
  Gene Name: collagen, type IV, alpha 3 (Goodpasture antigen) binding protein
  Uniprot ID: Q9Y5P4
  ENSP ID: ENSP00000383996
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKPYSRSSSMSSIDLVSASDDVHRFSSQVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 18991 - protein, 126 aa, Homo sapiens
  Payload ID: 3810
  Gene Symbol: COL4A3BP
  Gene Name: collagen, type IV, alpha 3 (Goodpasture antigen) binding protein
  ENSP ID: ENSP00000424244
  MOD_RES (1)..(1): Any amino acid
XPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 18992 - protein, 1690 aa, Homo sapiens
  Payload ID: 3811
  Gene Symbol: COL4A4
  Gene Name: collagen, type IV, alpha 4
  Uniprot ID: P53420
  ENSP ID: ENSP00000379866
MWSLHIVLMRCSFRLTKSLATGPWSLILILFSVQYVYGSGKKYIGPCGGRDCSVCHCVPEKGSRGPPGPPGPQGPIGPLGAPGPIGLSGEKGMRGDRGPPGAAGDKGDKGPTGVPGFPGLDGIPGHPGPPGPRGKPGMSGHNGSRGDPGFPGGRGALGPGGPLGHPGEKGEKGNSVFILGAVKGIQGDRGDPGLPGLPGSWGAGGPAGPTGYPGEPGLVGPPGQPGRPGLKGNPGVGVKGQMGDPGEVGQQGSPGPTLLVEPPDFCLYKGEKGIKGIPGMVGLPGPPGRKGESGIGAKGEKGIPGFPGPRGDPGSYGSPGFPGLKGELGLVGDPGLFGLIGPKGDPGNRGHPGPPGVLVTPPLPLKGPPGDPGFPGRYGETGDVGPPGPPGLLGRPGEACAGMIGPPGPQGFPGLPGLPGEAGIPGRPDSAPGKPGKPGSPGLPGAPGLQGLPGSSVIYCSVGNPGPQGIKGKVGPPGGRGPKGEKGNEGLCACEPGPMGPPGPPGLPGRQGSKGDLGLPGWLGTKGDPGPPGAEGPPGLPGKHGASGPPGNKGAKGDMVVSRVKGHKGERGPDGPPGFPGQPGSHGRDGHAGEKGDPGPPGDHEDATPGGKGFPGPLGPPGKAGPVGPPGLGFPGPPGERGHPGVPGHPGVRGPDGLKGQKGDTISCNVTYPGRHGPPGFDGPPGPKGFPGPQGAPGLSGSDGHKGRPGTPGTAEIPGPPGFRGDMGDPGFGGEKGSSPVGPPGPPGSPGVNGQKGIPGDPAFGHLGPPGKRGLSGVPGIKGPRGDPGCPGAEGPAGIPGFLGLKGPKGREGHAGFPGVPGPPGHSCERGAPGIPGQPGLPGYPGSPGAPGGKGQPGDVGPPGPAGMKGLPGLPGRPGAHGPPGLPGIPGPFGDDGLPGPPGPKGPRGLPGFPGFPGERGKPGAEGCPGAKGEPGEKGMSGLPGDRGLRGAKGAIGPPGDEGEMAIISQKGTPGEPGPPGDDGFPGERGDKGTPGMQGRRGEPGRYGPPGFHRGEPGEKGQPGPPGPPGPPGSTGLRGFIGFPGLPGDQGEPGSPGPPGFSGIDGARGPKGNKGDPASHFGPPGPKGEPGSPGCPGHFGASGEQGLPGIQGPRGSPGRPGPPGSSGPPGCPGDHGMPGLRGQPGEMGDPGPRGLQGDPGIPGPPGIKGPSGSPGLNGLHGLKGQKGTKGASGLHDVGPPGPVGIPGLKGERGDPGSPGISPPGPRGKKGPPGPPGSSGPPGPAGATGRAPKDIPDPGPPGDQGPPGPDGPRGAPGPPGLPGSVDLLRGEPGDCGLPGPPGPPGPPGPPGYKGFPGCDGKDGQKGPVGFPGPQGPHGFPGPPGEKGLPGPPGRKGPTGLPGPRGEPGPPADVDDCPRIPGLPGAPGMRGPEGAMGLPGMRGPSGPGCKGEPGLDGRRGVDGVPGSPGPPGRKGDTGEDGYPGGPGPPGPIGDPGPKGFGPGYLGGFLLVLHSQTDQEPTCPLGMPRLWTGYSLLYLEGQEKAHNQDLGLAGSCLPVFSTLPFAYCNIHQVCHYAQRNDRSYWLASAAPLPMMPLSEEAIRPYVSRCAVCEAPAQAVAVHSQDQSIPPCPQTWRSLWIGYSFLMHTGAGDQGGGQALMSPGSCLEDFRAAPFLECQGRQGTCHFFANKYSFWLTTVKADLQFSSAPAPDTLKESQAQRQKISRCQVCVKYS

SEQ ID NO: 18993 - protein, 1691 aa, Homo sapiens
  Payload ID: 3812
  Gene Symbol: COL4A5
  Gene Name: collagen, type IV, alpha 5
  Uniprot ID: P29400
  ENSP ID: ENSP00000331902
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGPTGFQGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 18994 - protein, 1685 aa, Homo sapiens
  Payload ID: 3812
  Gene Symbol: COL4A5
  Gene Name: collagen, type IV, alpha 5
  Uniprot ID: P29400
  ENSP ID: ENSP00000354505
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 18995 - protein, 115 aa, Homo sapiens
  Payload ID: 3812
  Gene Symbol: COL4A5
  Gene Name: collagen, type IV, alpha 5
  ENSP ID: ENSP00000423520
  MOD_RES (1)..(1): Any amino acid
XGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLVNLSQKR

SEQ ID NO: 18996 - protein, 174 aa, Homo sapiens
  Payload ID: 3812
  Gene Symbol: COL4A5
  Gene Name: collagen, type IV, alpha 5
  ENSP ID: ENSP00000424137
  MOD_RES (1)..(1): Any amino acid
XDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKMIRRYVLGFVASPK

SEQ ID NO: 18997 - protein, 73 aa, Homo sapiens
  Payload ID: 3812
  Gene Symbol: COL4A5
  Gene Name: collagen, type IV, alpha 5
  ENSP ID: ENSP00000424845
FASRNDYSYWLSTPEPMPMSMQPLKGQSIQPFISRCAVCEAPAVVIAVHSQTIQIPHCPQGWDSLWIGYSFMM

SEQ ID NO: 18998 - protein, 1690 aa, Homo sapiens
  Payload ID: 3813
  Gene Symbol: COL4A6
  Gene Name: collagen, type IV, alpha 6
  Uniprot ID: Q14031
  ENSP ID: ENSP00000334733
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 18999 - protein, 1691 aa, Homo sapiens
  Payload ID: 3813
  Gene Symbol: COL4A6
  Gene Name: collagen, type IV, alpha 6
  Uniprot ID: Q14031
  ENSP ID: ENSP00000361290
MLINKLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 19000 - protein, 1707 aa, Homo sapiens
  Payload ID: 3813
  Gene Symbol: COL4A6
  Gene Name: collagen, type IV, alpha 6
  ENSP ID: ENSP00000378340
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGDCCCREVGKGDLDTERGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 19001 - protein, 1678 aa, Homo sapiens
  Payload ID: 3813
  Gene Symbol: COL4A6
  Gene Name: collagen, type IV, alpha 6
  ENSP ID: ENSP00000443707
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 19002 - protein, 1633 aa, Homo sapiens
  Payload ID: 3813
  Gene Symbol: COL4A6
  Gene Name: collagen, type IV, alpha 6
  ENSP ID: ENSP00000445236
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 19003 - protein, 1666 aa, Homo sapiens
  Payload ID: 3813
  Gene Symbol: COL4A6
  Gene Name: collagen, type IV, alpha 6
  ENSP ID: ENSP00000482970
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 19004 - protein, 678 aa, Homo sapiens
  Payload ID: 3814
  Gene Symbol: COL9A1
  Gene Name: collagen, type IX, alpha 1
  Uniprot ID: P20849
  ENSP ID: ENSP00000315252
MAWTARDRGALGLLLLGLCLCAAQRGPPGEQGPPGPPGPPGVPGIDGIDGDRGPKGPPGPPGPAGEPGKPGAPGKPGTPGADGLTGPDGSPGSIGSKGQKGEPGVPGSRGFPGRGIPGPPGPPGTAGLPGELGRVGPVGDPGRRGPPGPPGPPGPRGTIGFHDGDPLCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 19005 - protein, 921 aa, Homo sapiens
  Payload ID: 3814
  Gene Symbol: COL9A1
  Gene Name: collagen, type IX, alpha 1
  Uniprot ID: P20849
  ENSP ID: ENSP00000349790
MKTCWKIPVFFFVCSFLEPWASAAVKRRPRFPVNSNSNGGNELCPKIRIGQDDLPGFDLISQFQVDKAASRRAIQRVVGSATLQVAYKLGNNVDFRIPTRNLYPSGLPEEYSFLTTFRMTGSTLKKNWNIWQIQDSSGKEQVGIKINGQTQSVVFSYKGLDGSLQTAAFSNLSSLFDSQWHKIMIGVERSSATLFVDCNRIESLPIKPRGPIDIDGFAVLGKLADNPQVSVPFELQWMLIHCDPLRPRRETCHELPARITPSQTTDERGPPGEQGPPGPPGPPGVPGIDGIDGDRGPKGPPGPPGPAGEPGKPGAPGKPGTPGADGLTGPDGSPGSIGSKGQKGEPGVPGSRGFPGRGIPGPPGPPGTAGLPGELGRVGPVGDPGRRGPPGPPGPPGPRGTIGFHDGDPLCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 19006 - protein, 328 aa, Homo sapiens
  Payload ID: 3814
  Gene Symbol: COL9A1
  Gene Name: collagen, type IX, alpha 1
  Uniprot ID: P20849
  ENSP ID: ENSP00000359527
MKTCWKIPVFFFVCSFLEPWASAAVKRRPRFPVNSNSNGGNELCPKIRIGQDDLPGFDLISQFQVDKAASRRAIQRVVGSATLQVAYKLGNNVDFRIPTRNLYPSGLPEEYSFLTTFRMTGSTLKKNWNIWQIQDSSGKEQVGIKINGQTQSVVFSYKGLDGSLQTAAFSNLSSLFDSQWHKIMIGVERSSATLFVDCNRIESLPIKPRGPIDIDGFAVLGKLADNPQVSVPFELQWMLIHCDPLRPRRETCHELPARITPSQTTDERGPPGEQGPPGPPGPPGVPGIDGIDGDRGPKGPPGPPGPAGEPGKPGAPGKPGTPGADTSP

SEQ ID NO: 19007 - protein, 83 aa, Homo sapiens
  Payload ID: 3815
  Gene Symbol: COL9A2
  Gene Name: collagen, type IX, alpha 2
  ENSP ID: ENSP00000361821
MAAATASPRSLLVLLQVVVLALAQIRGPPGERGPPGPPGPPGVPGSDGIDGPPGPVGLPGEIGIRGPKGDPGPDGPSGPPGPP

SEQ ID NO: 19008 - protein, 689 aa, Homo sapiens
  Payload ID: 3815
  Gene Symbol: COL9A2
  Gene Name: collagen, type IX, alpha 2
  Uniprot ID: Q14055
  ENSP ID: ENSP00000361834
MAAATASPRSLLVLLQVVVLALAQIRGPPGERGPPGPPGPPGVPGSDGIDGDNGPPGKAGPPGPKGEPGKAGPDGPDGKPGIDGLTGAKGEPGPMGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYPGMAGPKGETGPHGYKGMVGAIGATGPPGEEGPRGPPGRAGEKGDEGSPGIRGPQGITGPKGATGPPGINGKDGTPGTPGMKGSAGQAGQPGSPGHQGLAGVPGQPGTKGGPGDQGEPGPQGLPGFSGPPGKEGEPGPRGEIGPQGIMGQKGDQGERGPVGQPGPQGRQGPKGEQGPPGIPGPQGLPGVKGDKGSPGKTGPRGKVGDPGVAGLPGEKGEKGESGEPGPKGQQGVRGEPGYPGPSGDAGAPGVQGYPGPPGPRGLAGNRGVPGQPGRQGVEGRDATDQHIVDVALKMLQEQLAEVAVSAKREALGAVGMMGPPGPPGPPGYPGKQGPHGHPGPRGVPGIVGAVGQIGNTGPKGKRGEKGDPGEVGRGHPGMPGPPGIPGLPGRPGQAINGKDGDRGSPGAPGEAGRPGLPGPVGLPGFCEPAACLGASAYASARLTEPGSIKGP

SEQ ID NO: 19009 - protein, 226 aa, Homo sapiens
  Payload ID: 3815
  Gene Symbol: COL9A2
  Gene Name: collagen, type IX, alpha 2
  ENSP ID: ENSP00000388493
  MOD_RES (1)..(1): Any amino acid
XSPFRGPPGAAGARRGPPGERGPPGPPGPPGVPGSDGIDGDNGPPGKAGPPGPKGEPGKAGPDGPDGKPGIDGLTGAKGEPGPMGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYP

SEQ ID NO: 19010 - protein, 182 aa, Homo sapiens
  Payload ID: 3815
  Gene Symbol: COL9A2
  Gene Name: collagen, type IX, alpha 2
  ENSP ID: ENSP00000407377
GNQALREGRALRGSRAPPEFQGPKACQASKETRAPQGRPGPAAKWVTQGWPASPERKARRASPASRGPRDSKEYVENPATLAPAGMRAPQGFRATLVPPALEDWPGTEACQDSPGDRAWRATGRGRRECQAGSPGCGGHDGSSRTSWAPWVPRQAGPPWAPWPSGRSWHRGSRGSDRQHGAQ

SEQ ID NO: 19011 - protein, 684 aa, Homo sapiens
  Payload ID: 3816
  Gene Symbol: COL9A3
  Gene Name: collagen, type IX, alpha 3
  Uniprot ID: Q14050
  ENSP ID: ENSP00000341640
MAGPRACAPLLLLLLLGELLAAAGAQRVGLPGPPGPPGPPGKPGQDGIDGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 19012 - protein, 191 aa, Homo sapiens
  Payload ID: 3816
  Gene Symbol: COL9A3
  Gene Name: collagen, type IX, alpha 3
  ENSP ID: ENSP00000394280
MWWSSTQNAGTEGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQ

SEQ ID NO: 19013 - protein, 1838 aa, Homo sapiens
  Payload ID: 3817
  Gene Symbol: COL5A1
  Gene Name: collagen, type V, alpha 1
  Uniprot ID: P20908
  ENSP ID: ENSP00000360882
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGEPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 19014 - protein, 210 aa, Homo sapiens
  Payload ID: 3817
  Gene Symbol: COL5A1
  Gene Name: collagen, type V, alpha 1
  ENSP ID: ENSP00000360885
  MOD_RES (1)..(1): Any amino acid
XRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGSKMARWPKEQPSTWYSQYKRGSLLSYVDAEGNPVGVVQMTFLRLLSASAHQNVTYHCYQSVAWQDAATGSYDKALRFLGSNDEEMSYDNNPYIRALVDGCA

SEQ ID NO: 19015 - protein, 1838 aa, Homo sapiens
  Payload ID: 3817
  Gene Symbol: COL5A1
  Gene Name: collagen, type V, alpha 1
  ENSP ID: ENSP00000481360
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGEPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGSKMARWPKEQPSTWYSQYKRGSLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 19016 - protein, 1499 aa, Homo sapiens
  Payload ID: 3818
  Gene Symbol: COL5A2
  Gene Name: collagen, type V, alpha 2
  Uniprot ID: P05997
  ENSP ID: ENSP00000364000
MMANWAEARPLLILIVLLGQFVSIKAQEEDEDEGYGEEIACTQNGQMYLNRDIWKPAPCQICVCDNGAILCDKIECQDVLDCADPVTPPGECCPVCSQTPGGGNTNFGRGRKGQKGEPGLVPVVTGIRGRPGPAGPPGSQGPRGERGPKGRPGPRGPQGIDGEPGVPGQPGAPGPPGHPSHPGPDGLSRPFSAQMAGLDEKSGLGSQVGLMPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGAMGPLGPRGMPGERGRLGPQGAPGQRGAHGMPGKPGPMGPLGIPGSSGFPGNPGMKGEAGPTGARGPEGPQGQRGETGPPGPVGSPGLPGAIGTDGTPGAKGPTGSPGTSGPPGSAGPPGSPGPQGSTGPQGIRGQPGDPGVPGFKGEAGPKGEPGPHGIQGPIGPPGEEGKRGPRGDPGTVGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIRGQPGSMGLPGPKGSSGDPGKPGEAGNAGVPGQRGAPGKDGEVGPSGPVGPPGLAGERGEQGPPGPTGFQGLPGPPGPPGEGGKPGDQGVPGDPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGARGLPGPLGPPGPAGPTGEKGEPGPRGLVGPPGSRGNPGSRGENGPTGAVGFAGPQGPDGQPGVKGEPGEPGQKGDAGSPGPQGLAGSPGPHGPNGVPGLKGGRGTQGPPGATGFPGSAGRVGPPGPAGAPGPAGPLGEPGKEGPPGLRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGPPGRAGKRGLPGPQGPRGDKGDHGDRGDRGQKGHRGFTGLQGLPGPPGPNGEQGSAGIPGPFGPRGPPGPVGPSGKEGNPGPLGPIGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 19017 - protein, 1112 aa, Homo sapiens
  Payload ID: 3818
  Gene Symbol: COL5A2
  Gene Name: collagen, type V, alpha 2
  ENSP ID: ENSP00000482184
MPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGDPGTVGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIRGQPGSMGLPGPKGSSGDPGKPGEAGNAGVPGQRGAPGKDGEVGPSGPVGPPGLAGERGEQGPPGPTGFQGLPGPPGPPGEGGKPGDQGVPGDPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGARGLPGPLGPPGPAGPTGEKGEPGPRGLVGPPGSRGNPGSRGENGPTGAVGFAGPQGPDGQPGVKGEPGEPGQKGDAGSPGPQGLAGSPGPHGPNGVPGLKGGRGTQGPPGATGFPGSAGRVGPPGPAGAPGPAGPLGEPGKEGPPGLRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGPPGRAGKRGLPGPQGPRGDKGDHGDRGDRGQKGHRGFTGLQGLPGPPGPNGEQGSAGIPGPFGPRGPPGPVGPSGKEGNPGPLGPIGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 19018 - protein, 1745 aa, Homo sapiens
  Payload ID: 3819
  Gene Symbol: COL5A3
  Gene Name: collagen, type V, alpha 3
  Uniprot ID: P25940
  ENSP ID: ENSP00000264828
MGNRRDLGQPRAGLCLLLAALQLLPGTQADPVDVLKALGVQGGQAGVPEGPGFCPQRTPEGDRAFRIGQASTLGIPTWELFPEGHFPENFSLLITLRGQPANQSVLLSIYDERGARQLGLALGPALGLLGDPFRPLPQQVNLTDGRWHRVAVSIDGEMVTLVADCEAQPPVLGHGPRFISIAGLTVLGTQDLGEKTFEGDIQELLISPDPQAAFQACERYLPDCDNLAPAATVAPQGEPETPRPRRKGKGKGRKKGRGRKGKGRKKNKEIWTSSPPPDSAENQTSTDIPKTETPAPNLPPTPTPLVVTSTVTTGLNATILERSLDPDSGTELGTLETKAAREDEEGDDSTMGPDFRAAEYPSRTQFQIFPGAGEKGAKGEPAVIEKGQQFEGPPGAPGPQGVVGPSGPPGPPGFPGDPGPPGPAGLPGIPGIDGIRGPPGTVIMMPFQFAGGSFKGPPVSFQQAQAQAVLQQTQLSMKGPPGPVGLTGRPGPVGLPGHPGLKGEEGAEGPQGPRGLQGPHGPPGRVGKMGRPGADGARGLPGDTGPKGDRGFDGLPGLPGEKGQRGDFGHVGQPGPPGEDGERGAEGPPGPTGQAGEPGPRGLLGPRGSPGPTGRPGVTGIDGAPGAKGNVGPPGEPGPPGQQGNHGSQGLPGPQGLIGTPGEKGPPGNPGIPGLPGSDGPLGHPGHEGPTGEKGAQGPPGSAGPPGYPGPRGVKGTSGNRGLQGEKGEKGEDGFPGFKGDVGLKGDQGKPGAPGPRGEDGPEGPKGQAGQAGEEGPPGSAGEKGKLGVPGLPGYPGRPGPKGSIGFPGPLGPIGEKGKSGKTGQPGLEGERGPPGSRGERGQPGATGQPGPKGDVGQDGAPGIPGEKGLPGLQGPPGFPGPKGPPGHQGKDGRPGHPGQRGELGFQGQTGPPGPAGVLGPQGKTGEVGPLGERGPPGPPGPPGEQGLPGLEGREGAKGELGPPGPLGKEGPAGLRGFPGPKGGPGDPGPTGLKGDKGPPGPVGANGSPGERGPLGPAGGIGLPGQSGSEGPVGPAGKKGSRGERGPPGPTGKDGIPGPLGPLGPPGAAGPSGEEGDKGDVGAPGHKGSKGDKGDAGPPGQPGIRGPAGHPGPPGADGAQGRRGPPGLFGQKGDDGVRGFVGVIGPPGLQGLPGPPGEKGEVGDVGSMGPHGAPGPRGPQGPTGSEGTPGLPGGVGQPGAVGEKGERGDAGDPGPPGAPGIPGPKGDIGEKGDSGPSGAAGPPGKKGPPGEDGAKGSVGPTGLPGDLGPPGDPGVSGIDGSPGEKGDPGDVGGPGPPGASGEPGAPGPPGKRGPSGHMGREGREGEKGAKGEPGPDGPPGRTGPMGARGPPGRVGPEGLRGIPGPVGEPGLLGAPGQMGPPGPLGPSGLPGLKGDTGPKGEKGHIGLIGLIGPPGEAGEKGDQGLPGVQGPPGPKGDPGPPGPIGSLGHPGPPGVAGPLGQKGSKGSPGSMGPRGDTGPAGPPGPPGAPAELHGLRRRRRFVPVPLPVVEGGLEEVLASLTSLSLELEQLRRPPGTAERPGLVCHELHRNHPHLPDGEYWIDPNQGCARDSFRVFCNFTAGGETCLYPDKKFEIVKLASWSKEKPGGWYSTFRRGKKFSYVDADGSPVNVVQLNFLKLLSATARQNFTYSCQNAAAWLDEATGDYSHSARFLGTNGEELSFNQTTAATVSVPQDGCRLRKGQTKTLFEFSSSRAGFLPLWDVAATDFGQTNQKFGFELGPVCFSS

SEQ ID NO: 19019 - protein, 1028 aa, Homo sapiens
  Payload ID: 3820
  Gene Symbol: COL6A1
  Gene Name: collagen, type VI, alpha 1
  Uniprot ID: P12109
  ENSP ID: ENSP00000355180
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 19020 - protein, 1026 aa, Homo sapiens [sequence omitted]

SEQ ID NO: 19021 - protein, 1019 aa, Homo sapiens
  Payload ID: 3821
  Gene Symbol: COL6A2
  Gene Name: collagen, type VI, alpha 2
  Uniprot ID: P12110
  ENSP ID: ENSP00000300527
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 19022 - protein, 828 aa, Homo sapiens
  Payload ID: 3821
  Gene Symbol: COL6A2
  Gene Name: collagen, type VI, alpha 2
  Uniprot ID: P12110
  ENSP ID: ENSP00000312529
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTGLDGAVLC

SEQ ID NO: 19023 - protein, 918 aa, Homo sapiens
  Payload ID: 3821
  Gene Symbol: COL6A2
  Gene Name: collagen, type VI, alpha 2
  Uniprot ID: P12110
  ENSP ID: ENSP00000380870
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTDAPWPGGEPPVTFLRTEEGPDATFPRTIPLIQQLLNATELTQDPAAYSQLVAVLVYTAERAKFATGVERQDWMELFIDTFKLVHRDIVGDPETALALC

SEQ ID NO: 19024 - protein, 828 aa, Homo sapiens; identical to SEQ ID NO: 19022
  Payload ID: 3821
  Gene Symbol: COL6A2
  Gene Name: collagen, type VI, alpha 2
  Uniprot ID: P12110
  ENSP ID: ENSP00000387115

SEQ ID NO: 19025 - protein, 180 aa, Homo sapiens
  Payload ID: 3821
  Gene Symbol: COL6A2
  Gene Name: collagen, type VI, alpha 2
  ENSP ID: ENSP00000390418
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERA

SEQ ID NO: 19026 - protein, 250 aa, Homo sapiens
  Payload ID: 3821
  Gene Symbol: COL6A2
  Gene Name: collagen, type VI, alpha 2
  ENSP ID: ENSP00000395751
GNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCGSEVSPVPPDDPATPPDCEKRCGALDVVFVIDSSESIGYTNFTLEKNFVINVVNRLGAIAKDPKSETGTRVGVVQYSHEGTFEAIQLDDERIDSLSSFKEAVKN

SEQ ID NO: 19027 - protein, 3177 aa, Homo sapiens
  Payload ID: 3822
  Gene Symbol: COL6A3
  Gene Name: collagen, type VI, alpha 3
  Uniprot ID: P12111
  ENSP ID: ENSP00000295550
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 19028 - protein, 2569 aa, Homo sapiens
  Payload ID: 3822
  Gene Symbol: COL6A3
  Gene Name: collagen, type VI, alpha 3
  ENSP ID: ENSP00000315609
MRKHRHLPLVAVFCLFLSGFPTTHAQQQQAVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPFHGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 19029 - protein, 2971 aa, Homo sapiens
  Payload ID: 3822
  Gene Symbol: COL6A3
  Gene Name: collagen, type VI, alpha 3
  Uniprot ID: P12111
  ENSP ID: ENSP00000315873
MRKHRHLPLVAVFCLFLSGFPTTHAQQQQAAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 19030 - protein, 1036 aa, Homo sapiens
  Payload ID: 3822
  Gene Symbol: COL6A3
  Gene Name: collagen, type VI, alpha 3
  Uniprot ID: P12111
  ENSP ID: ENSP00000375860
MRKHRHLPLVAVFCLFLSGFPTTHAQQQQAVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPGEMGASEVLLGAFSI

SEQ ID NO: 19031 - protein, 1237 aa, Homo sapiens
  Payload ID: 3822
  Gene Symbol: COL6A3
  Gene Name: collagen, type VI, alpha 3
  Uniprot ID: P12111
  ENSP ID: ENSP00000375861
MRKHRHLPLVAVFCLFLSGFPTTHAQQQQAAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPGEMGASEVLLGAFSI

SEQ ID NO: 19032 - protein, 2971 aa, Homo sapiens; identical to SEQ ID NO: 19029
  Payload ID: 3822
  Gene Symbol: COL6A3
  Gene Name: collagen, type VI, alpha 3
  Uniprot ID: P12111
  ENSP ID: ENSP00000386844

SEQ ID NO: 19033 - protein, 708 aa, Homo sapiens
  Payload ID: 3822
  Gene Symbol: COL6A3
  Gene Name: collagen, type VI, alpha 3
  ENSP ID: ENSP00000389539
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKI

SEQ ID NO: 19034 - protein, 2570 aa, Homo sapiens
  Payload ID: 3822
  Gene Symbol: COL6A3
  Gene Name: collagen, type VI, alpha 3
  Uniprot ID: P12111
  ENSP ID: ENSP00000418285
MRKHRHLPLVAVFCLFLSGFPTTHAQQQQAVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 19035 - protein, 173 aa, Homo sapiens
  Payload ID: 3822
  Gene Symbol: COL6A3
  Gene Name: collagen, type VI, alpha 3
  ENSP ID: ENSP00000460277
PIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQEYGLNENW

SEQ ID NO: 19036 - protein, 2611 aa, Homo sapiens
  Payload ID: 3823
  Gene Symbol: COL6A5
  Gene Name: collagen, type VI, alpha 5
  ENSP ID: ENSP00000265379
MKILLIIFVLIIWTETLADQSPGPGPVYADVVFLVDSSDHLGPKSFPFVKTFINKMINSLPIEANKYRVALAQYSDEFHSEFHLSTFKGRSPMLNHLKKNFQFIGGSLQIGKALQEAHRTYFSAPINGRDRKQFPPILVVLASAESEDEVEEASKALQKDGVKIISVGVQKASEENLKAMATSHFHFNLRTIRDLSTFSQNMTQIIKDVTKYKEGAVDADMQVHFPISCQKDSLADLVFLVDESLGTGGNLRHLQTFLENITSSMDVKENCMRLGLMSYSNSAKTISFLKSSTTQSEFQQQIKNLSIQVGKSNTGAAIDQMRRDGFSESYGSRRAQGVPQIAVLVTHRPSDDEVHDAALNLRLEDVNVFALSIQGANNTQLEEIVSYPPEQTISTLKSYADLETYSTKFLKKLQNEIWSQISTYAEQRNLDKTGCVDTKEADIHFLIDGSSSIQEKQFEQIKRFMLEVTEMFSIGPDKVRVGVVQYSDDTEVEFYITDYSNDIDLRKAIFNIKQLTGGTYTGKALDYILQIIKNGMKDRMSKVPCYLIVLTDGMSTDRVVEPAKRLRAEQITVHAVGIGAANKIELQEIAGKEERVSFGQNFDALKSIKNEVVREICAEKGCEDMKADIMFLVDSSWSIGNENFRKMKIFMKNLLTKIQIGADKTQIGVVQFSDKTKEEFQLNRYFTQQEISDAIDRMSLINEGTLTGKALNFVGQYFTHSKGARLGAKKFLILITDGVAQDDVRDPARILRGKDVTIFSVGVYNANRSQLEEISGDSSLVFHVENFDHLKALERKLIFRVCALHDCKRITLLDVVFVLDHSGSIKKQYQDHMINLTIHLVKKADVGRDRVQFGALKYSDQPNILFYLNTYSNRSAIIENLRKRRDTGGNTYTAKALKHANALFTEEHGSRIKQNVKQMLIVITDGESHDHDQLNDTALELRNKGITIFAVGVGKANQKELEGMAGNKNNTIYVDNFDKLKDVFTLVQERMCTEAPEVCHLQEADVIFLCDGSDRVSNSDFVTMTTFLSDLIDNFDIQSQRMKIGMAQFGSNYQSIIELKNSLTKTQWKTQIQNVSKSGGFPRIDFALKKVSNMFNLHAGGRRNAGVPQTLVVITSGDPRYDVADAVKTLKDLGICVLVLGIGDVYKEHLLPITGNSEKIITFQDFDKLKNVDVKKRIIREICQSCGKTNCFMDIVVGFDISTHVQGQPLFQGHPQLESYLPGILEDISSIKGVSCGAGTEAQVSLAFKVNSDQGFPAKFQIYQKAVFDSLLQVNVSGPTHLNAQFLRSLWDTFKDKSASRGQVLLIFSDGLQSESNIMLENQSDRLREAGLDALLVVSLNTTAHHEFSSFEFGKRFDYRTHLTIGMRELGKKLSQYLGNIAERTCCCTFCKCPGIPGPHGTRGLQAMKGSQGLKGSRGHRGEDGNPGVRGDTGPQGDKGIAGCPGAWGQKGLKGFSGPKGGHGDDGIDGLDGEEGCHGFPGIKGEKGDPGSQGSPGSRGAPGQYGEKGFPGDPGNPGQNNNIKGQKGSKGEQGRQGRSGQKGVQGSPSSRGSRGREGQRGLRGVSGEPGNPGPTGTLGAEGLQGPQGSQGNPGRKGEKGSQGQKGPQGSPGLMGAKGSTGRPGLLGKKGEPGLPGDLGPVGQTGQRGRQGDSGIPGYGQMGRKGVKGPRGFPGDAGQKGDIGNPGIPGGPGPKGFRGLALTVGLKGEEGSRGLPGPPGQRGIKGMAGQPVYSQCDLIRFLREHSLFKNAYPTELVFALDNSYDVTEESFNKTRDIITSIVNDLNIRENNCPVGARVAMVSYNSGTSYLIRWSDYNRKKQLLQQLSQIKYQDTTEPRDVGNAMRFVTRNVFKRTYAGANVRRVAVFFSNGQTASRSSIITATMEFSALDISPTVFAFDERVFLEAFGFDNTGTFQVIPVPPNGENQTLERLRRCALCYDKCFPNACIREAFLPEDSYMDVVFLIDNSRNIAKDEFKAVKALVSSVIDNFNIASDPLISDSGDRIALLSYSPWESSRRKMGTVKTEFDFITYDNQLLMKNHIQTSFQQLNGEATIGRALLWTTENLFPETPYLRKHKVIFVVSAGENYERKEFVKMMALRAKCQGYVIFVISLGSTRKDDMEELASYPLDQHLIQLGRIHKPDLNYIAKFLKPFLYSVRRGFNQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLLLPGIYEIKTENGDLFDEFDSQAQHLLVLGNNHSSGSETATDLMQKLYLLFSTEKLAMKDKEKAHLEEISALVVDKQQEKEDKEMEATDI

SEQ ID NO: 19037 - protein, 2615 aa, Homo sapiens
  Payload ID: 3823
  Gene Symbol: COL6A5
  Gene Name: collagen, type VI, alpha 5
  Uniprot ID: A8TX70
  ENSP ID: ENSP00000309762
MKILLIIFVLIIWTETLADQSPGPGPVYADVVFLVDSSDHLGPKSFPFVKTFINKMINSLPIEANKYRVALAQYSDEFHSEFHLSTFKGRSPMLNHLKKNFQFIGGSLQIGKALQEAHRTYFSAPINGRDRKQFPPILVVLASAESEDEVEEASKALQKDGVKIISVGVQKASEENLKAMATSHFHFNLRTIRDLSTFSQNMTQIIKDVTKYKEGAVDADMQVHFPISCQKDSLADLVFLVDESLGTGGNLRHLQTFLENITSSMDVKENCMRLGLMSYSNSAKTISFLKSSTTQSEFQQQIKNLSIQVGKSNTGAAIDQMRRDGFSESYGSRRAQGVPQIAVLVTHRPSDDEVHDAALNLRLEDVNVFALSIQGANNTQLEEIVSYPPEQTISTLKSYADLETYSTKFLKKLQNEIWSQISTYAEQRNLDKTGCVDTKEADIHFLIDGSSSIQEKQFEQIKRFMLEVTEMFSIGPDKVRVGVVQYSDDTEVEFYITDYSNDIDLRKAIFNIKQLTGGTYTGKALDYILQIIKNGMKDRMSKVPCYLIVLTDGMSTDRVVEPAKRLRAEQITVHAVGIGAANKIELQEIAGKEERVSFGQNFDALKSIKNEVVREICAEKGCEDMKADIMFLVDSSWSIGNENFRKMKIFMKNLLTKIQIGADKTQIGVVQFSDKTKEEFQLNRYFTQQEISDAIDRMSLINEGTLTGKALNFVGQYFTHSKGARLGAKKFLILITDGVAQDDVRDPARILRGKDVTIFSVGVYNANRSQLEEISGDSSLVFHVENFDHLKALERKLIFRVCALHDCKRITLLDVVFVLDHSGSIKKQYQDHMINLTIHLVKKADVGRDRVQFGALKYSDQPNILFYLNTYSNRSAIIENLRKRRDTGGNTYTAKALKHANALFTEEHGSRIKQNVKQMLIVITDGESHDHDQLNDTALELRNKGITIFAVGVGKANQKELEGMAGNKNNTIYVDNFDKLKDVFTLVQERMCTEAPEVCHLQEADVIFLCDGSDRVSNSDFVTMTTFLSDLIDNFDIQSQRMKIGMAQFGSNYQSIIELKNSLTKTQWKTQIQNVSKSGGFPRIDFALKKVSNMFNLHAGGRRNAGVPQTLVVITSGDPRYDVADAVKTLKDLGICVLVLGIGDVYKEHLLPITGNSEKIITFQDFDKLKNVDVKKRIIREICQSCGKTNCFMDIVVGFDISTHVQGQPLFQGHPQLESYLPGILEDISSIKGVSCGAGTEAQVSLAFKVNSDQGFPAKFQIYQKAVFDSLLQVNVSGPTHLNAQFLRSLWDTFKDKSASRGQVLLIFSDGLQSESNIMLENQSDRLREAGLDALLVVSLNTTAHHEFSSFEFGKRFDYRTHLTIGMRELGKKLSQYLGNIAERTCCCTFCKCPGIPGPHGTRGLQAMKGSQGLKGSRGHRGEDGNPGVRGDTGPQGDKGIAGCPGAWGQKGLKGFSGPKGGHGDDGIDGLDGEEGCHGFPGIKGEKGDPGSQGSPGSRGAPGQYGEKGFPGDPGNPGQNNNIKGQKGSKGEQGRQGRSGQKGVQGSPSSRGSRGREGQRGLRGVSGEPGNPGPTGTLGAEGLQGPQGSQGNPGRKGEKGSQGQKGPQGSPGLMGAKGSTGRPGLLGKKGEPGLPGDLGPVGQTGQRGRQGDSGIPGYGQMGRKGVKGPRGFPGDAGQKGDIGNPGIPGGPGPKGFRGLALTVGLKGEEGSRGLPGPPGQRGIKGMAGQPVYSQCDLIRFLREHSPCWKEKCPAYPTELVFALDNSYDVTEESFNKTRDIITSIVNDLNIRENNCPVGARVAMVSYNSGTSYLIRWSDYNRKKQLLQQLSQIKYQDTTEPRDVGNAMRFVTRNVFKRTYAGANVRRVAVFFSNGQTASRSSIITATMEFSALDISPTVFAFDERVFLEAFGFDNTGTFQVIPVPPNGENQTLERLRRCALCYDKCFPNACIREAFLPEDSYMDVVFLIDNSRNIAKDEFKAVKALVSSVIDNFNIASDPLISDSGDRIALLSYSPWESSRRKMGTVKTEFDFITYDNQLLMKNHIQTSFQQLNGEATIGRALLWTTENLFPETPYLRKHKVIFVVSAGENYERKEFVKMMALRAKCQGYVIFVISLGSTRKDDMEELASYPLDQHLIQLGRIHKPDLNYIAKFLKPFLYSVRRGFNQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLLLPGIYEIKTENGDLFDEFDSQAQHLLVLGNNHSSGSETATDLMQKLYLLFSTEKLAMKDKEKAHLEEISALVVDKQQEKEDKEMEATDI

SEQ ID NO: 19038 - protein, 557 aa, Homo sapiens
  Payload ID: 3823
  Gene Symbol: COL6A5
  Gene Name: collagen, type VI, alpha 5
  ENSP ID: ENSP00000362250
IGRALLWTTENLFPETPYLRKHKVIFVVSAGENYERKEFVKMMALRAKCQGYVIFVISLGSTRKDDMEELASYPLDQHLIQLGRIHKPDLNYIAKFLKPFLYSVRRGFNQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLLLPGIYEIKTENGDLFDEFDSQAQHLLVLGNNHSSGSETATDLMQKLYLLFSTEKLAMKDKEKAHLEEISALVVDKQQEKEDGEDTRSS

SEQ ID NO: 19039 - protein, 778 aa, Homo sapiens
  Payload ID: 3823
  Gene Symbol: COL6A5
  Gene Name: collagen, type VI, alpha 5
  ENSP ID: ENSP00000422898
  MOD_RES (1)..(1): Any amino acid
XEKCPAYPTELVFALDNSYDVTEESFNKTRDIITSIVNDLNIRENNCPVGARVAMVSYNSGTSYLIRWSDYNRKKQLLQQLSQIKYQDTTEPRDVGNAMRFVTRNVFKRTYAGANVRRVAVFFSNGQTASRSSIITATMEFSALDISPTVFAFDERVFLEAFGFDNTGTFQVIPVPPNGENQTLERLRRCALCYDKCFPNACIREAFLPEDSYMDVVFLIDNSRNIAKDEFKAVKALVSSVIDNFNIASDPLISDSGDRIALLSYSPWESSRRKMGTVKTEFDFITYDNQLLMKNHIQTSFQQLNGEATIGRALLWTTENLFPETPYLRKHKVIFVVSAGENYERKEFVKMMALRAKCQGYVIFVISLGSTRKDDMEELASYPLDQHLIQLGRIHKPDLNYIAKFLKPFLYSVRRGFNQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLW

SEQ ID NO: 19040 - protein, 443 aa, Homo sapiens
  Payload ID: 3823
  Gene Symbol: COL6A5
  Gene Name: collagen, type VI, alpha 5
  ENSP ID: ENSP00000424968
NQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLLLPGIYEIKTENGDLFDEFDSQAQHLLVLGNNHSSGSETATDLMQKLYLLFSTEKLAMKDKEKAHLEEISALVVDKQQEKEDL

SEQ ID NO: 19041 - protein, 2263 aa, Homo sapiens
  Payload ID: 3824
  Gene Symbol: COL6A6
  Gene Name: collagen, type VI, alpha 6
  Uniprot ID: A6NMZ7
  ENSP ID: ENSP00000351310
MMLLILFLVIICSHISVNQDSGPEYADVVFLVDSSDRLGSKSFPFVKMFITKMISSLPIEADKYRVALAQYSDKLHSEFHLSTFKGRSPMLNHLRKNFGFIGGSLQIGKALQEAHRTYFSAPANGRDKKQFPPILVVLASSESEDNVEEASKALRKDGVKIISVGVQKASEENLKAMATSQFHFNLRTVRDLSMFSQNMTHIIKDVIKYKEGAVDDIFVEACQGPSMADVVFLLDMSINGSEENFDYLKGFLEESVSALDIKENCMRVGLVAYSNETKVINSLSMGINKSEVLQHIQNLSPRTGKAYTGAAIKKLRKEVFSARNGSRKNQGVPQIAVLVTHRDSEDNVTKAAVNLRREGVTIFTLGIEGASDTQLEKIASHPAEQYVSKLKTFADLAAHNQTFLKKLRNQITHTVSVFSERTETLKSGCVDTEEADIYLLIDGSGSTQATDFHEMKTFLSEVVGMFNIAPHKVRVGAVQYADSWDLEFEINKYSNKQDLGKAIENIRQMGGNTNTGAALNFTLSLLQKAKKQRGNKVPCHLVVLTNGMSKDSILEPANRLREEHIRVYAIGIKEANQTQLREIAGEEKRVYYVHDFDALKDIRNQVVQEICTEEACKEMKADIMFLVDSSGSIGPENFSKMKTFMKNLVSKSQIGPDRVQIGVVQFSDINKEEFQLNRFMSQSDISNAIDQMAHIGQTTLTGSALSFVSQYFSPTKGARPNIRKFLILITDGEAQDIVKEPAVVLRQEGVIIYSVGVFGSNVTQLEEISGRPEMVFYVENFDILQRIEDDLVFGICSPREECKRIEVLDVVFVIDSSGSIDYDEYNIMKDFMIGLVKKADVGKNQVRFGALKYADDPEVLFYLDDFGTKLEVISVLQNDQAMGGSTYTAEALGFSDHMFTEARGSRLNKGVPQVLIVITDGESHDADKLNATAKALRDKGILVLAVGIDGANPVELLAMAGSSDKYFFVETFGGLKGIFSDVTASVCNSSKVDCEIDKVDLVFLMDGSTSIQPNDFKKMKEFLASVVQDFDVSLNRVRIGAAQFSDTYHPEFPLGTFIGEKEISFQIENIKQIFGNTHIGAALREVEHYFRPDMGSRINTGTPQVLLVLTDGQSQDEVAQAAEALRHRGIDIYSVGIGDVDDQQLIQITGTAEKKLTVHNFDELKKVNKRIVRNICTTAGESNCFVDVVVGFDVSTQEKGQTLLEGQPWMETYLQDILRAISSLNGVSCEVGTETQVSVAFQVTNAMEKYSPKFEIYSENILNSLKDITVKGPSLLNANLLDSLWDTFQNKSAARGKVVLLFSDGLDDDVEKLEQKSDELRKEGLNALITVALDGPADSSDLADLPYIEFGKGFEYRTQLSIGMRELGSRLSKQLVNVAERTCCCLFCKCIGGDGTMGDPGPPGKRGPPGFKGSEGYLGEEGIAGERGAPGPVGEQGTKGCYGTKGPKGNRGLNGQEGEVGENGIDGLNGEQGDNGLPGRKGEKGDEGSQGSPGKRGTPGDRGAKGLRGDPGAPGVDSSIEGPTGLKGERGRQGRRGWPGPPGTPGSRRKTAAHGRRGHTGPQGTAGIPGPDGLEGSLGLKGPQGPRGEAGVKGEKGGVGSKGPQGPPGPGGEAGNQGRLGSQGNKGEPGDLGEKGAVGFPGPRGLQGNDGSPGYGSVGRKGAKGQEGFPGESGPKGEIGDPGGPGETGLKGARGKMISAGLPGEMGSPGEPGPPGRKGVKGAKGLASFSTCELIQYVRDRSPGRHGKPECPVHPTELVFALDHSRDVTEQEFERMKEMMAFLVRDIKVRENSCPVGAHIAILSYNSHARHLVRFSDAYKKSQLLREIETIPYERSSASREIGRAMRFISRNVFKRTLPGAHTRKIATFFSSGQSADAHSITTAAMEFGALEIIPVVITFSNVPSVRRAFAIDDTGTFQVIVVPSGADYIPALERLQRCTFCYDVCKPDASCDQARPPPVQSYMDAAFLLDASRNMGSAEFEDIRAFLGALLDHFEITPEPETSVTGDRVALLSHAPPDFLPNTQKSPVRAEFNLTTYRSKRLMKRHVHESVKQLNGDAFIGHALQWTLDNVFLSTPNLRRNKVIFVISAGETSHLDGEILKKESLRAKCQGYALFVFSLGPIWDDKELEDLASHPLDHHLVQLGRIHKPDHSYGVKFVKSFINSIRRAINKYPPINLKIKCNRLNSIDPKQPPRPFRSFVPGPLKATLKEDVLQKAKFFQDKKYLSRVARSGRDDAIQNFMRSTSHTFKNGRMIESAPKQHD

SEQ ID NO: 19042 - protein, 259 aa, Homo sapiens
  Payload ID: 3824
  Gene Symbol: COL6A6
  Gene Name: collagen, type VI, alpha 6
  ENSP ID: ENSP00000422921
  MOD_RES (1)..(1): Any amino acid
XTNAMEKYSPKFEIYSENILNSLKDITVKGPSLLNANLLDSLWDTFQNKSAARGKVVLLFSDGLDDDVEKLEQKSDELRKEGLNALITVALDGPADSSDLADLPYIEFGKGFEYRTQLSIGMRELGSRLSKQLVNVAERTCCCLFCKCIGGDGTMGDPGPPGKRLHVKRVVDFFKKQGSERMERKGPPGFKGSEGYLGEEGIAGERGAPGPVGEQGTKGCYGTKGPKGNRGLNGQEGEVGENGIDGLNGEQGDNGLPGR

SEQ ID NO: 19043 - protein, 298 aa, Homo sapiens
  Payload ID: 3824
  Gene Symbol: COL6A6
  Gene Name: collagen, type VI, alpha 6
  ENSP ID: ENSP00000426006
  MOD_RES (1)..(1): Any amino acid
XLNGVSCEVGTETQVSVAFQVTNAMEKYSPKFEIYSENILNSLKDITVKGPSLLNANLLDSLWDTFQNKSAARGKVVLLFSDGLDDDVEKLEQKSDELRKEGLNALITVALDGPADSSDLADLPYIEFGKGFEYRTQLSIGMRELGSRLSKQLVNVAERTCCCLFCKCIGGDGTMGDPGPPGKRGPPGFKGSEGYLGEEGIAGERGAPGPVGEQGTKGCYGTKGPKGNRGLNGQEGEVGENGIDGLNGEQGDNGLPGRKGEKGDEGSQGSPGKRGTPGDRGAKGLRGDPVSARAANWS

SEQ ID NO: 19044 - protein, 2944 aa, Homo sapiens
  Payload ID: 3825
  Gene Symbol: COL7A1
  Gene Name: collagen, type VII, alpha 1
  Uniprot ID: Q02388
  ENSP ID: ENSP00000332371
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPCSLPLDEGSCTAYTLRWYHRAVTGSTEACHPFVYGGCGGNANRFGTREACERRCPPRVVQSQGTGTAQD

SEQ ID NO: 19045 - protein, 173 aa, Homo sapiens
  Payload ID: 3825
  Gene Symbol: COL7A1
  Gene Name: collagen, type VII, alpha 1
  ENSP ID: ENSP00000391608
MSALACGLPVPVPCLNSHLSMGQKGAPGPKGFKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRGEDGRPGQEGPRGLTGPPGSRGERGEKG

SEQ ID NO: 19046 - protein, 744 aa, Homo sapiens
  Payload ID: 3826
  Gene Symbol: COL8A1
  Gene Name: collagen, type VIII, alpha 1
  Uniprot ID: P27658
  ENSP ID: ENSP00000261037
MAVLPGPLQLLGVLLTISLSSIRLIQAGAYYGIKPLPPQIPPQMPPQIPQYQPLGQQVPHMPLAKDGLAMGKEMPHLQYGKEYPHLPQYMKEIQPAPRMGKEAVPKKGKEIPLASLRGEQGPRGEPGPRGPPGPPGLPGHGIPGIKGKPGPQGYPGVGKPGMPGMPGKPGAMGMPGAKGEIGQKGEIGPMGIPGPQGPPGPHGLPGIGKPGGPGLPGQPGPKGDRGPKGLPGPQGLRGPKGDKGFGMPGAPGVKGPPGMHGPPGPVGLPGVGKPGVTGFPGPQGPLGKPGAPGEPGPQGPIGVPGVQGPPGIPGIGKPGQDGIPGQPGFPGGKGEQGLPGLPGPPGLPGIGKPGFPGPKGDRGMGGVPGALGPRGEKGPIGAPGIGGPPGEPGLPGIPGPMGPPGAIGFPGPKGEGGIVGPQGPPGPKGEPGLQGFPGKPGFLGEVGPPGMRGLPGPIGPKGEAGQKGVPGLPGVPGLLGPKGEPGIPGDQGLQGPPGIPGIGGPSGPIGPPGIPGPKGEPGLPGPPGFPGIGKPGVAGLHGPPGKPGALGPQGQPGLPGPPGPPGPPGPPAVMPPTPPPQGEYLPDMGLGIDGVKPPHAYGAKKGKNGGPAYEMPAFTAELTAPFPPVGAPVKFNKLLYNGRQNYNPQTGIFTCEVPGVYYFAYHVHCKGGNVWVALFKNNEPVMYTYDEYKKGFLDQASGSAVLLLRPGDRVFLQMPSEQAAGLYAGQYVHSSFSGYLLYPM

SEQ ID NO: 19047 - protein, 744 aa, Homo sapiens; identical to SEQ ID NO: 19046
  Payload ID: 3826
  Gene Symbol: COL8A1
  Gene Name: collagen, type VIII, alpha 1
  Uniprot ID: P27658
  ENSP ID: ENSP00000273342

SEQ ID NO: 19048 - protein, 113 aa, Homo sapiens
  Payload ID: 3826
  Gene Symbol: COL8A1
  Gene Name: collagen, type VIII, alpha 1
  ENSP ID: ENSP00000387589
MAVLPGPLQLLGVLLTISLSSIRLIQAGAYYGIKPLPPQIPPQMPPQIPQYQPLGQQVPHMPLAKDGLAMGKEMPHLQYGKEYPHLPQYMKEIQPAPRMGKEAVPKKGKEIPL

SEQ ID NO: 19049 - protein, 202 aa, Homo sapiens
  Payload ID: 3826
  Gene Symbol: COL8A1
  Gene Name: collagen, type VIII, alpha 1
  ENSP ID: ENSP00000482679
MAVLPGPLQLLGVLLTISLSSIRLIQAGAYYGIKPLPPQIPPQMPPQIPQYQPLGQQVPHMPLAKDGLAMGKEMPHLQYGKEYPHLPQYMKEIQPAPRMGKEAVPKKGKEIPLASLRGEQGPRGEPGPRGPPGPPGLPGHGIPGIKGKPGPQGYPGVGKPGMPGMPGKPGAMGMPGAKGEIGQKGEIGPMGIPGPQGPPGPH

SEQ ID NO: 19050 - protein, 703 aa, Homo sapiens
  Payload ID: 3827
  Gene Symbol: COL8A2
  Gene Name: collagen, type VIII, alpha 2
  Uniprot ID: P25067
  ENSP ID: ENSP00000305913
MLGTLTPLSSLLLLLLVLVLGCGPRASSGGGAGGAAGYAPVKYIQPMQKGPVGPPFREGKGQYLEMPLPLLPMDLKGEPGPPGKPGPRGPPGPPGFPGKPGMGKPGLHGQPGPAGPPGFSRMGKAGPPGLPGKVGPPGQPGLRGEPGIRGDQGLRGPPGPPGLPGPSGITIPGKPGAQGVPGPPGFQGEPGPQGEPGPPGDRGLKGDNGVGQPGLPGAPGQGGAPGPPGLPGPAGLGKPGLDGLPGAPGDKGESGPPGVPGPRGEPGAVGPKGPPGVDGVGVPGAAGLPGPQGPSGAKGEPGTRGPPGLIGPTGYGMPGLPGPKGDRGPAGVPGLLGDRGEPGEDGEPGEQGPQGLGGPPGLPGSAGLPGRRGPPGPKGEAGPGGPPGVPGIRGDQGPSGLAGKPGVPGERGLPGAHGPPGPTGPKGEPGFTGRPGGPGVAGALGQKGDLGLPGQPGLRGPSGIPGLQGPAGPIGPQGLPGLKGEPGLPGPPGEGRAGEPGTAGPTGPPGVPGSPGITGPPGPPGPPGPPGAPGAFDETGIAGLHLPNGGVEGAVLGKGGKPQFGLGELSAHATPAFTAVLTSPFPASGMPVKFDRTLYNGHSGYNPATGIFTCPVGGVYYFAYHVHVKGTNVWVALYKNNVPATYTYDEYKKGYLDQASGGAVLQLRPNDQVWVQMPSDQANGLYSTEYIHSSFSGFLLCPT

SEQ ID NO: 19051 - protein, 703 aa, Homo sapiens; identical to SEQ ID NO: 19050
  Payload ID: 3827
  Gene Symbol: COL8A2
  Gene Name: collagen, type VIII, alpha 2
  Uniprot ID: P25067
  ENSP ID: ENSP00000380901

SEQ ID NO: 19052 - protein, 638 aa, Homo sapiens
  Payload ID: 3827
  Gene Symbol: COL8A2
  Gene Name: collagen, type VIII, alpha 2
  ENSP ID: ENSP00000436433
MPLPLLPMDLKGEPGPPGKPGPRGPPGPPGFPGKPGMGKPGLHGQPGPAGPPGFSRMGKAGPPGLPGKVGPPGQPGLRGEPGIRGDQGLRGPPGPPGLPGPSGITIPGKPGAQGVPGPPGFQGEPGPQGEPGPPGDRGLKGDNGVGQPGLPGAPGQGGAPGPPGLPGPAGLGKPGLDGLPGAPGDKGESGPPGVPGPRGEPGAVGPKGPPGVDGVGVPGAAGLPGPQGPSGAKGEPGTRGPPGLIGPTGYGMPGLPGPKGDRGPAGVPGLLGDRGEPGEDGEPGEQGPQGLGGPPGLPGSAGLPGRRGPPGPKGEAGPGGPPGVPGIRGDQGPSGLAGKPGVPGERGLPGAHGPPGPTGPKGEPGFTGRPGGPGVAGALGQKGDLGLPGQPGLRGPSGIPGLQGPAGPIGPQGLPGLKGEPGLPGPPGEGRAGEPGTAGPTGPPGVPGSPGITGPPGPPGPPGPPGAPGAFDETGIAGLHLPNGGVEGAVLGKGGKPQFGLGELSAHATPAFTAVLTSPFPASGMPVKFDRTLYNGHSGYNPATGIFTCPVGGVYYFAYHVHVKGTNVWVALYKNNVPATYTYDEYKKGYLDQASGGAVLQLRPNDQVWVQMPSDQANGLYSTEYIHSSFSGFLLCPT

SEQ ID NO: 19053 - protein, 427 aa, Homo sapiens
  Payload ID: 3827
  Gene Symbol: COL8A2
  Gene Name: collagen, type VIII, alpha 2
  ENSP ID: ENSP00000484406
MLGTLTPLSSLLLLLLVLVLGCGPRASSGGGAGGAAGYAPVKYIQPMQKGPVGPPFREGKGQYLEMPLPLLPMDLKGEPGPPGKPGPRGPPGPPGFPGKPGMGKPGLHGQPGPAGPPGFSRMGKAGPPGLPGKVGPPGQPGLRGEPGIRGDQGLRGPPGPPGLPGPSGITIPGKPGAQGVPGPPGFQGEPGPQGEPGPPGDRGLKGDNGVGQPGLPGAPGQGGAPGPPGLPGPAGLGKPGLDGLPGAPGDKGESGPPGAFDETGIAGLHLPNGGVEGAVLGKGGKPQFGLGELSAHATPAFTAVLTSPFPASGMPVKFDRTLYNGHSGYNPATGIFTCPVGGVYYFAYHVHVKGTNVWVALYKNNVPATYTYDEYKKGYLDQASGGAVLQLRPNDQVWVQMPSDQANGLYSTEYIHSSFSGFLLCPT

SEQ ID NO: 19054 - protein, 680 aa, Homo sapiens
  Payload ID: 3828
  Gene Symbol: COL10A1
  Gene Name: collagen, type X, alpha 1
  Uniprot ID: Q03692
  ENSP ID: ENSP00000243222
MLPQIPFLLLVSLNLVHGVFYAERYQMPTGIKGPLPNTKTQFFIPYTIKSKGIAVRGEQGTPGPPGPAGPRGHPGPSGPPGKPGYGSPGLQGEPGLPGPPGPSAVGKPGVPGLPGKPGERGPYGPKGDVGPAGLPGPRGPPGPPGIPGPAGISVPGKPGQQGPTGAPGPRGFPGEKGAPGVPGMNGQKGEMGYGAPGRPGERGLPGPQGPTGPSGPPGVGKRGENGVPGQPGIKGDRGFPGEMGPIGPPGPQGPPGERGPEGIGKPGAAGAPGQPGIPGTKGLPGAPGIAGPPGPPGFGKPGLPGLKGERGPAGLPGGPGAKGEQGPAGLPGKPGLTGPPGNMGPQGPKGIPGSHGLPGPKGETGPAGPAGYPGAKGERGSPGSDGKPGYPGKPGLDGPKGNPGLPGPKGDPGVGGPPGLPGPVGPAGAKGMPGHNGEAGPRGAPGIPGTRGPIGPPGIPGFPGSKGDPGSPGPPGPAGIATKGLNGPTGPPGPPGPRGHSGEPGLPGPPGPPGPPGQAVMPEGFIKAGQRPSLSGTPLVSANQGVTGMPVSAFTVILSKAYPAIGTPIPFDKILYNRQQHYDPRTGIFTCQIPGIYYFSYHVHVKGTHVWVGLYKNGTPVMYTYDEYTKGYLDQASGSAIIDLTENDQVWLQLPNAESNGLYSSEYVHSSFSGFLVAPM

SEQ ID NO: 19055 - protein, 680 aa, Homo sapiens; identical to SEQ ID NO: 19054
  Payload ID: 3828
  Gene Symbol: COL10A1
  Gene Name: collagen, type X, alpha 1
  Uniprot ID: Q03692
  ENSP ID: ENSP00000327368

SEQ ID NO: 19056 - protein, 51 aa, Homo sapiens
  Payload ID: 3828
  Gene Symbol: COL10A1
  Gene Name: collagen, type X, alpha 1
  ENSP ID: ENSP00000392712
MLPQIPFLLLVSLNLVHGVFYAERYQMPTGIKGPLPNTKTQFFIPYTIKSK

SEQ ID NO: 19057 - protein, 216 aa, Homo sapiens
  Payload ID: 3828
  Gene Symbol: COL10A1
  Gene Name: collagen, type X, alpha 1
  ENSP ID: ENSP00000411285
MLPQIPFLLLVSLNLVHGVFYAERYQMPTGIKGPLPNTKTQFFIPYTIKSKGIAVRGEQGTPGPPGPAGPRGHPGPSGPPGKPGYGSPGLQGEPGLPGPPGPSAVGKPGVPGLPGKPGERGPYGPKGDVGPAGLPGPRGPPGPPGIPGPAGISVPGKPGQQGPTGAPGPRGFPGEKGAPGVPGMNGQKGEMGYGAPGRPGERGLPGPQGPTGPSGP

SEQ ID NO: 19058 - protein, 1767 aa, Homo sapiens
  Payload ID: 3829
  Gene Symbol: COL11A1
  Gene Name: collagen, type XI, alpha 1
  Uniprot ID: P12107
  ENSP ID: ENSP00000302551
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 19059 - protein, 1818 aa, Homo sapiens
  Payload ID: 3829
  Gene Symbol: COL11A1
  Gene Name: collagen, type XI, alpha 1
  Uniprot ID: P12107
  ENSP ID: ENSP00000351163
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEKKKSNFKKKMRTVATKSKEKSKKFTPPKSEKFSSKKKKSYQASAKAKLGVKANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 19060 - protein, 1806 aa, Homo sapiens
  Payload ID: 3829
  Gene Symbol: COL11A1
  Gene Name: collagen, type XI, alpha 1
  Uniprot ID: P12107
  ENSP ID: ENSP00000359114
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 19061 - protein, 569 aa, Homo sapiens
  Payload ID: 3829
  Gene Symbol: COL11A1
  Gene Name: collagen, type XI, alpha 1
  ENSP ID: ENSP00000408640
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEKKKSNFKKKMRTVATKSKEKSKKFTPPKSEKFSSKKKKSYQASAKAKLGVKANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGD

SEQ ID NO: 19062 - protein, 200 aa, Homo sapiens
  Payload ID: 3829
  Gene Symbol: COL11A1
  Gene Name: collagen, type XI, alpha 1
  ENSP ID: ENSP00000410177
YRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEVRSTRPEKVFVFQ

SEQ ID NO: 19063 - protein, 1690 aa, Homo sapiens
  Payload ID: 3829
  Gene Symbol: COL11A1
  Gene Name: collagen, type XI, alpha 1
  Uniprot ID: P12107
  ENSP ID: ENSP00000426533
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 19064 - protein, 694 aa, Homo sapiens
  Payload ID: 3829
  Gene Symbol: COL11A1
  Gene Name: collagen, type XI, alpha 1
  ENSP ID: ENSP00000489428
  MOD_RES (1)..(1): Any amino acid
XPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKDFRCHWFHWIPWVSRCQWRERCTGSSWQTRPSGSAWSNGSSRFKRCKRSHWETWAKGHFRWRWPSWPSR

SEQ ID NO: 19065 - protein, 1736 aa, Homo sapiens
  Payload ID: 3830
  Gene Symbol: COL11A2
  Gene Name: collagen, type XI, alpha 2
  ENSP ID: ENSP00000339915
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 19066 - protein, 1629 aa, Homo sapiens
  Payload ID: 3830
  Gene Symbol: COL11A2
  Gene Name: collagen, type XI, alpha 2
  ENSP ID: ENSP00000355123
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 19067 - protein, 1650 aa, Homo sapiens
  Payload ID: 3830
  Gene Symbol: COL11A2
  Gene Name: collagen, type XI, alpha 2
  ENSP ID: ENSP00000363840
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 19068 - protein, 1650 aa, Homo sapiens
  Payload ID: 3830
  Gene Symbol: COL11A2
  Gene Name: collagen, type XI, alpha 2
  Uniprot ID: P13942
  ENSP ID: ENSP00000372565
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 19069 - protein, 290 aa, Homo sapiens
  Payload ID: 3830
  Gene Symbol: COL11A2
  Gene Name: collagen, type XI, alpha 2
  Uniprot ID: P13942
  ENSP ID: ENSP00000372566
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQVRELGEPPSAAHPREGRHPGISPP

SEQ ID NO: 19070 - protein, 1650 aa, Homo sapiens; identical to SEQ ID NO: 19067
  Payload ID: 3830
  Gene Symbol: COL11A2
  Gene Name: collagen, type XI, alpha 2
  ENSP ID: ENSP00000372706

SEQ ID NO: 19071 - protein, 290 aa, Homo sapiens; identical to SEQ ID NO: 19069
  Payload ID: 3830
  Gene Symbol: COL11A2
  Gene Name: collagen, type XI, alpha 2
  Uniprot ID: P13942
  ENSP ID: ENSP00000378620

SEQ ID NO: 19072 - protein, 333 aa, Homo sapiens
  Payload ID: 3830
  Gene Symbol: COL11A2
  Gene Name: collagen, type XI, alpha 2
  ENSP ID: ENSP00000388108
  MOD_RES (1)..(1): Any amino acid
XNQSPQAHRSTVPHTAGLGQLCLLGFGMDWRASEAWMVPRAPKGAWDPRESQDLLDNRAPLGPRVFPGPRVPSALMERRVLKGSQGSPACLGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 19073 - protein, 1650 aa, Homo sapiens; identical to SEQ ID NO: 19067
  Payload ID: 3830
  Gene Symbol: COL11A2
  Gene Name: collagen, type XI, alpha 2
  ENSP ID: ENSP00000388309

SEQ ID NO: 19074 - protein, 624 aa, Homo sapiens
  Payload ID: 3830
  Gene Symbol: COL11A2
  Gene Name: collagen, type XI, alpha 2
  ENSP ID: ENSP00000388775
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPP

SEQ ID NO: 19075 - protein, 624 aa, Homo sapiens; identical to SEQ ID NO: 19074
  Payload ID: 3830
  Gene Symbol: COL11A2
  Gene Name: collagen, type XI, alpha 2
  ENSP ID: ENSP00000394196

SEQ ID NO: 19076 - protein, 290 aa, Homo sapiens
  Payload ID: 3830
  Gene Symbol: COL11A2
  Gene Name: collagen, type XI, alpha 2
  ENSP ID: ENSP00000396587
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQVRELGEPPSAAHPREGRHPGISPP

SEQ ID NO: 19077 - protein, 624 aa, Homo sapiens
  Payload ID: 3830
  Gene Symbol: COL11A2
  Gene Name: collagen, type XI, alpha 2
  ENSP ID: ENSP00000398170
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPP

SEQ ID NO: 19078 - protein, 624 aa, Homo sapiens; identical to SEQ ID NO: 19077
  Payload ID: 3830
  Gene Symbol: COL11A2
  Gene Name: collagen, type XI, alpha 2
  ENSP ID: ENSP00000398256

SEQ ID NO: 19079 - protein, 290 aa, Homo sapiens; identical to SEQ ID NO: 19069
  Payload ID: 3830
  Gene Symbol: COL11A2
  Gene Name: collagen, type XI, alpha 2
  Uniprot ID: P13942
  ENSP ID: ENSP00000400813

SEQ ID NO: 19080 - protein, 333 aa, Homo sapiens; identical to SEQ ID NO: 19072
  Payload ID: 3830
  Gene Symbol: COL11A2
  Gene Name: collagen, type XI, alpha 2
  ENSP ID: ENSP00000402987
  MOD_RES (1)..(1): Any amino acid

SEQ ID NO: 19081 - protein, 1623 aa, Homo sapiens
  Payload ID: 3830
  Gene Symbol: COL11A2
  Gene Name: collagen, type XI, alpha 2
  ENSP ID: ENSP00000404513
  MOD_RES (1)..(1): Any amino acid
XAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 19082 - protein, 624 aa, Homo sapiens; identical to SEQ ID NO: 19077
  Payload ID: 3830
  Gene Symbol: COL11A2
  Gene Name: collagen, type XI, alpha 2
  ENSP ID: ENSP00000405520

SEQ ID NO: 19083 - protein, 290 aa, Homo sapiens; identical to SEQ ID NO: 19069
  Payload ID: 3830
  Gene Symbol: COL11A2
  Gene Name: collagen, type XI, alpha 2
  Uniprot ID: P13942
  ENSP ID: ENSP00000406347

SEQ ID NO: 19084 - protein, 1650 aa, Homo sapiens
  Payload ID: 3830
  Gene Symbol: COL11A2
  Gene Name: collagen, type XI, alpha 2
  ENSP ID: ENSP00000408123
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 19085 - protein, 263 aa, Homo sapiens
  Payload ID: 3830
  Gene Symbol: COL11A2
  Gene Name: collagen, type XI, alpha 2
  ENSP ID: ENSP00000408523
  MOD_RES (1)..(1): Any amino acid
XAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQVRELGEPPSAAHPREGRHPGISPP

SEQ ID NO: 19086 - protein, 1650 aa, Homo sapiens; identical to SEQ ID NO: 19067
  Payload ID: 3830
  Gene Symbol: COL11A2
  Gene Name: collagen, type XI, alpha 2
  ENSP ID: ENSP00000408627

SEQ ID NO: 19087 - protein, 290 aa, Homo sapiens; identical to SEQ ID NO: 19069
  Payload ID: 3830
  Gene Symbol: COL11A2
  Gene Name: collagen, type XI, alpha 2
  Uniprot ID: P13942
  ENSP ID: ENSP00000410284

SEQ ID NO: 19088 - protein, 597 aa, Homo sapiens
  Payload ID: 3830
  Gene Symbol: COL11A2
  Gene Name: collagen, type XI, alpha 2
  ENSP ID: ENSP00000415296
  MOD_RES (1)..(1): Any amino acid
XAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPP

SEQ ID NO: 19089 - protein, 624 aa, Homo sapiens
  Payload ID: 3830
  Gene Symbol: COL11A2
  Gene Name: collagen, type XI, alpha 2
  ENSP ID: ENSP00000416619
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPP

SEQ ID NO: 19090 - protein, 1629 aa, Homo sapiens; identical to SEQ ID NO: 19066
  Payload ID: 3830
  Gene Symbol: COL11A2
  Gene Name: collagen, type XI, alpha 2
  ENSP ID: ENSP00000446870

SEQ ID NO: 19091 - protein, 1736 aa, Homo sapiens; identical to SEQ ID NO: 19065
  Payload ID: 3830
  Gene Symbol: COL11A2
  Gene Name: collagen, type XI, alpha 2
  ENSP ID: ENSP00000447062

SEQ ID NO: 19092 - protein, 1629 aa, Homo sapiens
  Payload ID: 3830
  Gene Symbol: COL11A2
  Gene Name: collagen, type XI, alpha 2
  Uniprot ID: P13942
  ENSP ID: ENSP00000447864
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 19093 - protein, 1736 aa, Homo sapiens
  Payload ID: 3830
  Gene Symbol: COL11A2
  Gene Name: collagen, type XI, alpha 2
  ENSP ID: ENSP00000448701
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 19094 - protein, 1736 aa, Homo sapiens
  Payload ID: 3830
  Gene Symbol: COL11A2
  Gene Name: collagen, type XI, alpha 2
  ENSP ID: ENSP00000448715
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 19095 - protein, 1736 aa, Homo sapiens; identical to SEQ ID NO: 19093
  Payload ID: 3830
  Gene Symbol: COL11A2
  Gene Name: collagen, type XI, alpha 2
  ENSP ID: ENSP00000448931

SEQ ID NO: 19096 - protein, 1736 aa, Homo sapiens
  Payload ID: 3830
  Gene Symbol: COL11A2
  Gene Name: collagen, type XI, alpha 2
  Uniprot ID: P13942
  ENSP ID: ENSP00000449275
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 19097 - protein, 1629 aa, Homo sapiens
  Payload ID: 3830
  Gene Symbol: COL11A2
  Gene Name: collagen, type XI, alpha 2
  ENSP ID: ENSP00000449320
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 19098 - protein, 1629 aa, Homo sapiens; identical to SEQ ID NO: 19066
  Payload ID: 3830
  Gene Symbol: COL11A2
  Gene Name: collagen, type XI, alpha 2
  ENSP ID: ENSP00000450046

SEQ ID NO: 19099 - protein, 1629 aa, Homo sapiens; identical to SEQ ID NO: 19066
  Payload ID: 3830
  Gene Symbol: COL11A2
  Gene Name: collagen, type XI, alpha 2
  ENSP ID: ENSP00000450084

SEQ ID NO: 19100 - protein, 1899 aa, Homo sapiens
  Payload ID: 3831
  Gene Symbol: COL12A1
  Gene Name: collagen, type XII, alpha 1
  Uniprot ID: Q99715
  ENSP ID: ENSP00000305147
MRSRLPPALAALGAALLLSSIEAEGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 19101 - protein, 3063 aa, Homo sapiens
  Payload ID: 3831
  Gene Symbol: COL12A1
  Gene Name: collagen, type XII, alpha 1
  Uniprot ID: Q99715
  ENSP ID: ENSP00000325146
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 19102 - protein, 638 aa, Homo sapiens
  Payload ID: 3831
  Gene Symbol: COL12A1
  Gene Name: collagen, type XII, alpha 1
  ENSP ID: ENSP00000393217
  MOD_RES (1)..(1): Any amino acid
XKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTPPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNL

SEQ ID NO: 19103 - protein, 756 aa, Homo sapiens
  Payload ID: 3831
  Gene Symbol: COL12A1
  Gene Name: collagen, type XII, alpha 1
  ENSP ID: ENSP00000399812
VSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPEPYVPEGGAYLPEREPFIVPVEPERTAEYEDYGADEPAEEPPEPHRRWRRALPHGPGQ

SEQ ID NO: 19104 - protein, 2987 aa, Homo sapiens
  Payload ID: 3831
  Gene Symbol: COL12A1
  Gene Name: collagen, type XII, alpha 1
  Uniprot ID: Q99715
  ENSP ID: ENSP00000412864
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 19105 - protein, 3062 aa, Homo sapiens
  Payload ID: 3831
  Gene Symbol: COL12A1
  Gene Name: collagen, type XII, alpha 1
  ENSP ID: ENSP00000421216
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGTLLPL

SEQ ID NO: 19106 - protein, 207 aa, Homo sapiens
  Payload ID: 3831
  Gene Symbol: COL12A1
  Gene Name: collagen, type XII, alpha 1
  ENSP ID: ENSP00000423423
VIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVKT

SEQ ID NO: 19107 - protein, 1874 aa, Homo sapiens
  Payload ID: 3831
  Gene Symbol: COL12A1
  Gene Name: collagen, type XII, alpha 1
  ENSP ID: ENSP00000483232
MECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQHSRFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 19108 - protein, 695 aa, Homo sapiens
  Payload ID: 3832
  Gene Symbol: COL13A1
  Gene Name: collagen, type XIII, alpha 1
  Uniprot ID: Q5TAT6
  ENSP ID: ENSP00000346553
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 19109 - protein, 683 aa, Homo sapiens
  Payload ID: 3832
  Gene Symbol: COL13A1
  Gene Name: collagen, type XIII, alpha 1
  Uniprot ID: Q5TAT6
  ENSP ID: ENSP00000350463
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 19110 - protein, 642 aa, Homo sapiens [sequence omitted]

SEQ ID NO: 19111 - protein, 247 aa, Homo sapiens
  Payload ID: 3832
  Gene Symbol: COL13A1
  Gene Name: collagen, type XIII, alpha 1
  ENSP ID: ENSP00000381947
  MOD_RES (1)..(1): Any amino acid
XIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 19112 - protein, 717 aa, Homo sapiens
  Payload ID: 3832
  Gene Symbol: COL13A1
  Gene Name: collagen, type XIII, alpha 1
  Uniprot ID: Q5TAT6
  ENSP ID: ENSP00000381949
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 19113 - protein, 174 aa, Homo sapiens
  Payload ID: 3832
  Gene Symbol: COL13A1
  Gene Name: collagen, type XIII, alpha 1
  ENSP ID: ENSP00000388774
  MOD_RES (1)..(1): Any amino acid
XGKDGPPGVKGENGHPGSPGEKGEKGETGQAGSPVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 19114 - protein, 645 aa, Homo sapiens
  Payload ID: 3832
  Gene Symbol: COL13A1
  Gene Name: collagen, type XIII, alpha 1
  Uniprot ID: Q5TAT6
  ENSP ID: ENSP00000428057
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGQPGTRGFPGFPGPIGLDGKPGHPGPKGDMGLTGPPGQPGPQGQKGEKGQCGEYPHRLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 19115 - protein, 686 aa, Homo sapiens
  Payload ID: 3832
  Gene Symbol: COL13A1
  Gene Name: collagen, type XIII, alpha 1
  Uniprot ID: Q5TAT6
  ENSP ID: ENSP00000428342
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 19116 - protein, 668 aa, Homo sapiens
  Payload ID: 3832
  Gene Symbol: COL13A1
  Gene Name: collagen, type XIII, alpha 1
  Uniprot ID: Q5TAT6
  ENSP ID: ENSP00000430061
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 19117 - protein, 582 aa, Homo sapiens
  Payload ID: 3832
  Gene Symbol: COL13A1
  Gene Name: collagen, type XIII, alpha 1
  ENSP ID: ENSP00000430089
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGVKGQPGEKGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGLDGPTGERRTWWPEQTQSGRIA

SEQ ID NO: 19118 - protein, 610 aa, Homo sapiens
  Payload ID: 3832
  Gene Symbol: COL13A1
  Gene Name: collagen, type XIII, alpha 1
  Uniprot ID: Q5TAT6
  ENSP ID: ENSP00000430173
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGEDGLPVQGCWNK

SEQ ID NO: 19119 - protein, 757 aa, Homo sapiens [sequence omitted]

SEQ ID NO: 19120 - protein, 1796 aa, Homo sapiens
  Payload ID: 3833
  Gene Symbol: COL14A1
  Gene Name: collagen, type XIV, alpha 1
  Uniprot ID: Q05707
  ENSP ID: ENSP00000297848
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGLAQYSGDPRIEWHLNAFSTKDEVIEAVRNLPYKGGNTLTGLALNYIFENSFKPEAGSRTGVSKIGILITDGKSQDDIIPPSRNLRESGVELFAIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEVCKAAKADLVFMVDGSWSIGDENFNKIISFLYSTVGALNKIGTDGTQVAMVQFTDDPRTEFKLNAYKTKETLLDAIKHISYKGGNTKTGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRAPHPDQPEFTPVQDELEAMELWGPGV

SEQ ID NO: 19121 - protein, 1780 aa, Homo sapiens
  Payload ID: 3833
  Gene Symbol: COL14A1
  Gene Name: collagen, type XIV, alpha 1
  Uniprot ID: Q05707
  ENSP ID: ENSP00000311809
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGLAQYSGDPRIEWHLNAFSTKDEVIEAVRNLPYKGGNTLTGLALNYIFENSFKPEAGSRTGVSKIGILITDGKSQDDIIPPSRNLRESGVELFAIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEVCKAAKADLVFMVDGSWSIGDENFNKIISFLYSTVGALNKIGTDGTQVAMVQFTDDPRTEFKLNAYKTKETLLDAIKHISYKGGNTKTGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRDLIPYNDYQH

SEQ ID NO: 19122 - protein, 149 aa, Homo sapiens
  Payload ID: 3833
  Gene Symbol: COL14A1
  Gene Name: collagen, type XIV, alpha 1
  ENSP ID: ENSP00000403640
GPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRGWMGIFLLDHPTLPSSPDHLPSLLFPGDGLLT

SEQ ID NO: 19123 - protein, 843 aa, Homo sapiens
  Payload ID: 3833
  Gene Symbol: COL14A1
  Gene Name: collagen, type XIV, alpha 1
  ENSP ID: ENSP00000409461
FDVGSEKTRIGLAQYSGDPRIEWHLNAFSTKDEVIEAVRNLPYKGGNTLTGLALNYIFENSFKPEAGSRTGVSKIGILITDGKSQDDIIPPSRNLRESGVELFAIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEGKRIIE

SEQ ID NO: 19124 - protein, 534 aa, Homo sapiens
  Payload ID: 3833
  Gene Symbol: COL14A1
  Gene Name: collagen, type XIV, alpha 1
  ENSP ID: ENSP00000428851
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGLAQYSGDPRIEWHLNAFSTKDEVIEAVRNLPYKGGNTLTGLALNYIFENSFKPEAGSRTGVSKIGILITDGKSQDDIIPPSRNLRESGVELFAIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTSP

SEQ ID NO: 19125 - protein, 336 aa, Homo sapiens
  Payload ID: 3833
  Gene Symbol: COL14A1
  Gene Name: collagen, type XIV, alpha 1
  ENSP ID: ENSP00000429123
  MOD_RES (1)..(1): Any amino acid
XVCQTPAIADIVILVDGSWSIGRFNFRLVRHFLENLVTAFDVGSEKTRIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINE

SEQ ID NO: 19126 - protein, 534 aa, Homo sapiens; identical to SEQ ID NO: 19124
  Payload ID: 3833
  Gene Symbol: COL14A1
  Gene Name: collagen, type XIV, alpha 1
  ENSP ID: ENSP00000443974

SEQ ID NO: 19127 - protein, 36 aa, Homo sapiens
  Payload ID: 3834
  Gene Symbol: COL19A1
  Gene Name: collagen, type XIX, alpha 1
  ENSP ID: ENSP00000416556
GPPGIQGIHQTLGGYYNKDNKGNDEHEAGGLKGDKV

SEQ ID NO: 19128 - protein, 60 aa, Homo sapiens
  Payload ID: 3834
  Gene Symbol: COL19A1
  Gene Name: collagen, type XIX, alpha 1
  ENSP ID: ENSP00000479481
MRLTGPWKLWLWMSIFLLPASTSVTVRDKTGIQANSLPNHQMLFIAFKSLKQILLRLKRP

SEQ ID NO: 19129 - protein, 1142 aa, Homo sapiens
  Payload ID: 3834
  Gene Symbol: COL19A1
  Gene Name: collagen, type XIX, alpha 1
  Uniprot ID: Q14993
  ENSP ID: ENSP00000480474
MRLTGPWKLWLWMSIFLLPASTSVTVRDKTEESCPILRIEGHQLTYDNINKLEVSGFDLGDSFSLRRAFCESDKTCFKLGSALLIRDTIKIFPKGLPEEYSVAAMFRVRRNAKKERWFLWQVLNQQNIPQISIVVDGGKKVVEFMFQATEGDVLNYIFRNRELRPLFDRQWHKLGISIQSQVISLYMDCNLIARRQTDEKDTVDFHGRTVIATRASDGKPVDIELHQLKIYCSANLIAQETCCEISDTKCPEQDGFGNIASSWVTAHASKMSSYLPAKQELKDQCQCIPNKGEAGLPGAPGSPGQKGHKGEPGENGLHGAPGFPGQKGEQGFEGSKGETGEKGEQGEKGDPALAGLNGENGLKGDLGPHGPPGPKGEKGDTGPPGPPALPGSLGIQGPQGPPGKEGQRGRRGKTGPPGKPGPPGPPGPPGIQGIHQTLGGYYNKDNKGNDEHEAGGLKGDKGETGLPGFPGSVGPKGQKGEPGEPFTKGEKGDRGEPGVIGSQGVKGEPGDPGPPGLIGSPGLKGQQGSAGSMGPRGPPGDVGLPGEHGIPGKQGIKGEKGDPGGIIGPPGLPGPKGEAGPPGKSLPGEPGLDGNPGAPGPRGPKGERGLPGVHGSPGDIGPQGIGIPGRTGAQGPAGEPGIQGPRGLPGLPGTPGTPGNDGVPGRDGKPGLPGPPGDPIALPLLGDIGALLKNFCGNCQASVPGLKSNKGEEGGAGEPGKYDSMARKGDIGPRGPPGIPGREGPKGSKGERGYPGIPGEKGDEGLQGIPGIPGAPGPTGPPGLMGRTGHPGPTGAKGEKGSDGPPGKPGPPGPPGIPFNERNGMSSLYKIKGGVNVPSYPGPPGPPGPKGDPGPVGEPGAMGLPGLEGFPGVKGDRGPAGPPGIAGMSGKPGAPGPPGVPGEPGERGPVGDIGFPGPEGPSGKPGINGKDGIPGAQGIMGKPGDRGPKGERGDQGIPGDRGSQGERGKPGLTGMKGAIGPMGPPGNKGSMGSPGHQGPPGSPGIPGIPADAVSFEEIKKYINQEVLRIFEERMAVFLSQLKLPAAMLAAQAYGRPGPPGKDGLPGPPGDPGPQGYRGQKGERGEPGIGLPGSPGLPGTSALGLPGSPGAPGPQGPPGPSGRCNPEDCLYPVSHAHQRTGGN

SEQ ID NO: 19130 - protein, 1388 aa, Homo sapiens
  Payload ID: 3835
  Gene Symbol: COL15A1
  Gene Name: collagen, type XV, alpha 1
  Uniprot ID: P39059
  ENSP ID: ENSP00000364140
MAPRRNNGQCWCLLMLLSVSTPLPAVTQTRGATETASQGHLDLTQLIGVPLPSSVSFVTGYGGFPAYSFGPGANVGRPARTLIPSTFFRDFAISVVVKPSSTRGGVLFAITDAFQKVIYLGLRLSGVEDGHQRIILYYTEPGSHVSQEAAAFSVPVMTHRWNRFAMIVQGEEVTLLVNCEEHSRIPFQRSSQALAFESSAGIFMGNAGATGLERFTGSLQQLTVHPDPRTPEELCDPEESSASGETSGLQEADGVAEILEAVTYTQASPKEAKVEPINTPPTPSSPFEDMELSGEPVPEGTLETTNMSIIQHSSPKQGSGEILNDTLEGVHSVDGDPITDSGSGAGAFLDIAEEKNLAATAAGLAEVPISTAGEAEASSVPTGGPTLSMSTENPEEGVTPGPDNEERLAATAAGEAEALASMPGEVEASGVAPGELDLSMSAQSLGEEATVGPSSEDSLTTAAAATEVSLSTFEDEEASGVPTDGLAPLTATMAPERAVTSGPGDEEDLAAATTEEPLITAGGEESGSPPPDGPPLPLPTVAPERWITPAQREHVGMKGQAGPKGEKGDAGEELPGPPEPSGPVGPTAGAEAEGSGLGWGSDVGSGSGDLVGSEQLLRGPPGPPGPPGLPGIPGKPGTDVFMGPPGSPGEDGPAGEPGPPGPEGQPGVDGATGLPGMKGEKGARGPNGSVGEKGDPGNRGLPGPPGKKGQAGPPGVMGPPGPPGPPGPPGPGCTMGLGFEDTEGSGSTQLLNEPKLSRPTAAIGLKGEKGDRGPKGERGMDGASIVGPPGPRGPPGHIKVLSNSLINITHGFMNFSDIPELVGPPGPDGLPGLPGFPGPRGPKGDTGLPGFPGLKGEQGEKGEPGAILTEDIPLERLMGKKGEPGMHGAPGPMGPKGPPGHKGEFGLPGRPGRPGLNGLKGTKGDPGVIMQGPPGLPGPPGPPGPPGAVINIKGAIFPIPVRPHCKMPVDTAHPGSPELITFHGVKGEKGSWGLPGSKGEKGDQGAQGPPGPPLDLAYLRHFLNNLKGENGDKGFKGEKGEKGDINGSFLMSGPPGLPGNPGPAGQKGETVVGPQGPPGAPGLPGPPGFGRPGDPGPPGPPGPPGPPAILGAAVALPGPPGPPGQPGLPGSRNLVTAFSNMDDMLQKAHLVIEGTFIYLRDSTEFFIRVRDGWKKLQLGELIPIPADSPPPPALSSNPHQLLPPPNPISSANYEKPALHLAALNMPFSGDIRADFQCFKQARAAGLLSTYRAFLSSHLQDLSTIVRKAERYSLPIVNLKGQVLFNNWDSIFSGHGGQFNMHIPIYSFDGRDIMTDPSWPQKVIWHGSSPHGVRLVDNYCEAWRTADTAVTGLASPLSTGKILDQKAYSCANRLIVLCIENSFMTDARK

SEQ ID NO: 19131 - protein, 1374 aa, Homo sapiens
  Payload ID: 3835
  Gene Symbol: COL15A1
  Gene Name: collagen, type XV, alpha 1
  ENSP ID: ENSP00000483455
MLLSVSTPLPAVTQTRGATETASQGHLDLTQLIGVPLPSSVSFVTGYGGFPAYSFGPGANVGRPARTLIPSTFFRDFAISVVVKPSSTRGGVLFAITDAFQKVIYLGLRLSGVEDGHQRIILYYTEPGSHVSQEAAAFSVPVMTHRWNRFAMIVQGEEVTLLVNCEEHSRIPFQRSSQALAFESSAGIFMGNAGATGLERFTGSLQQLTVHPDPRTPEELCDPEESSASGETSGLQEADGVAEILEAVTYTQASPKEAKVEPINTPPTPSSPFEDMELSGEPVPEGTLETTNMSIIQHSSPKQGKGAILNDTLEGVHSVDGDPITDSGSGAGAFLDIAEEKNLAATAAGLAEVPISTAGEAEASSVPTGGPTLSMSTENPEEGVTPGPDNEERLAATAAGEAEALASMPGEVEASGVAPGELDLSMSAQSLGEEATVGPSSEDSLTTAAAATEVSLSTFEDEEASGVPTDGLAPLTATMAPERAVTSGPGDEEDLAAATTEEPLITAGGEESGSPPPDGPPLPLPTVAPERWITPAQREHVGMKGQAGPKGEKGDAGEELPGPPEPSGPVGPTAGAEAEGSGLGWGSDVGSGSGDLVGSEQLLRGPPGPPGPPGLPGIPGKPGTDVFMGPPGSPGEDGPAGEPGPPGPEGQPGVDGATGLPGMKGEKGARGPNGSVGEKGDPGNRGLPGPPGKKGQAGPPGVMGPPGPPGPPGPPGPGCTMGLGFEDTEGSGSTQLLNEPKLSRPTAAIGLKGEKGDRGPKGERGMDGASIVGPPGPRGPPGHIKVLSNSLINITHGFMNFSDIPELVGPPGPDGLPGLPGFPGPRGPKGDTGLPGFPGLKGEQGEKGEPGAILTEDIPLERLMGKKGEPGMHGAPGPMGPKGPPGHKGEFGLPGRPGRPGLNGLKGTKGDPGVIMQGPPGLPGPPGPPGPPGAVINIKGAIFPIPVRPHCKMPVDTAHPGSPELITFHGVKGEKGSWGLPGSKGEKGDQGAQGPPGPPLDLAYLRHFLNNLKGENGDKGFKGEKGEKGDINGSFLMSGPPGLPGNPGPAGQKGETVVGPQGPPGAPGLPGPPGFGRPGDPGPPGPPGPPGPPAILGAAVALPGPPGPPGQPGLPGSRNLVTAFSNMDDMLQKAHLVIEGTFIYLRDSTEFFIRVRDGWKKLQLGELIPIPADSPPPPALSSNPHQLLPPPNPISSANYEKPALHLAALNMPFSGDIRADFQCFKQARAAGLLSTYRAFLSSHLQDLSTIVRKAERYSLPIVNLKGQVLFNNWDSIFSGHGGQFNMHIPIYSFDGRDIMTDPSWPQKVIWHGSSPHGVRLVDNYCEAWRTADTAVTGLASPLSTGKILDQKAYSCANRLIVLCIENSFMTDARK

SEQ ID NO: 19132 - protein, 308 aa, Homo sapiens
  Payload ID: 3836
  Gene Symbol: COL16A1
  Gene Name: collagen, type XVI, alpha 1
  ENSP ID: ENSP00000362771
KVYTRCFCLEEPQNSEVDAQLTGRISQKAERGAKVHQETAADECPPCVHGARDSNGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLP

SEQ ID NO: 19133 - protein, 966 aa, Homo sapiens
  Payload ID: 3836
  Gene Symbol: COL16A1
  Gene Name: collagen, type XVI, alpha 1
  ENSP ID: ENSP00000362772
MWVSWAPGLWLLGLWATFGHGANTGAQCPPSQQEGLKLEHSSSLPANVTGFNLIHRLSLMKTSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPGEKGPRGEKGEPGECSCPSQGDLIFSGMPGPPGIPGPPGPPGVPGLQVKGEKRMRSLGGRAHGSGWLLPAGPQGCCSPTPKTQTCHFSLLCLPASQGGKEGPLSL

SEQ ID NO: 19134 - protein, 1604 aa, Homo sapiens
  Payload ID: 3836
  Gene Symbol: COL16A1
  Gene Name: collagen, type XVI, alpha 1
  Uniprot ID: Q07092
  ENSP ID: ENSP00000362776
MWVSWAPGLWLLGLWATFGHGANTGAQCPPSQQEGLKLEHSSSLPANVTGFNLIHRLSLMKTSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPGEKGPRGEKGEPGECSCPSQGDLIFSGMPGAPGLWMGSSWQPGPQGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 19135 - protein, 224 aa, Homo sapiens
  Payload ID: 3836
  Gene Symbol: COL16A1
  Gene Name: collagen, type XVI, alpha 1
  ENSP ID: ENSP00000390281
GPPGSEGLPGPPGPAGPRGERGPQGNSGEKGDQGFQGQPGFPGPPGPPGFPGKVGSPGPPGPQAEKGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPK

SEQ ID NO: 19136 - protein, 235 aa, Homo sapiens
  Payload ID: 3836
  Gene Symbol: COL16A1
  Gene Name: collagen, type XVI, alpha 1
  ENSP ID: ENSP00000411457
GEPGPPGRGVQGPQGEPGAPGLPGIQGLPGPRGPPGPTGEKGAQGSPGVKGATGPVGPPGASVSGPPGRDGQQGQTGLRGTPGEKGPRGEKGEPGECSCPSQGDLIFSGMPGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPG

SEQ ID NO: 19137 - protein, 1497 aa, Homo sapiens
  Payload ID: 3837
  Gene Symbol: COL17A1
  Gene Name: collagen, type XVII, alpha 1
  Uniprot ID: Q9UMD9
  ENSP ID: ENSP00000340937
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEGSSSGNSSPEYPRKEFASSSTRGRSQTRESEIRVRLQSASPSTRWTELDDVKRLLKGSRSASVSPTRNSSNTLPIPKKGTVETKIVTASSQSVSGTYDATILDANLPSHVWSSTLPAGSSMGTYHNNMTTQSSSLLNTNAYSAGSVFGVPNNMASCSPTLHPGLSTSSSVFGMQNNLAPSLTTLSHGTTTTSTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGDLKTVSTKGKTTTADIHSYGSSGGGGSGGGGGVGGAGGGPWGPAPAWCPCGSCCSWWKWLLGLLLTWLLLLGLLFGLIALAEEVRKLKARVDELERIRRSILPYGDSMDRIEKDRLQGMAPAAGADLDKIGLHSDSQEELWMFVRKKLMMEQENGNLRGSPGPKGDMGSPGPKGDRGFPGTPGIPGPLGHPGPQGPKGQKGSVGDPGMEGPMGQRGREGPMGPRGEAGPPGSGEKGERGAAGEPGPHGPPGVPGSVGPKGSSGSPGPQGPPGPVGLQGLRGEVGLPGVKGDKGPMGPPGPKGDQGEKGPRGLTGEPGMRGLPGAVGEPGAKGAMGPAGPDGHQGPRGEQGLTGMPGIRGPPGPSGDPGKPGLTGPQGPQGLPGTPGRPGIKGEPGAPGKIVTSEGSSMLTVPGPPGPPGAMGPPGPPGAPGPAGPAGLPGHQEVLNLQGPPGPPGPRGPPGPSIPGPPGPRGPPGEGLPGPPGPPGSFLSNSETFLSGPPGPPGPPGPKGDQGPPGPRGHQGEQGLPGFSTSGSSSFGLNLQGPPGPPGPQGPKGDKGDPGVPGALGIPSGPSEGGSSSTMYVSGPPGPPGPPGPPGSISSSGQEIQQYISEYMQSDSIRSYLSGVQGPPGPPGPPGPVTTITGETFDYSELASHVVSYLRTSGYGVSLFSSSISSEDILAVLQRDDVRQYLRQYLMGPRGPPGPPGASGDGSLLSLDYAELSSRILSYMSSSGISIGLPGPPGPPGLPGTSYEELLSLLRGSEFRGIVGPPGPPGPPGIPGNVWSSISVEDLSSYLHTAGLSFIPGPPGPPGPPGPRGPPGVSGALATYAAENSDSFRSELISYLTSPDVRSFIVGPPGPPGPQGPPGDSRLLSTDASHSRGSSSSSHSSSVRRGSSYSSSMSTGGGGAGSLGAGGAFGEAAGDRGPYGTDIGPGGGYGAAAEGGMYAGNGGLLGADFAGDLDYNELAVRVSESMQRQGLLQGMAYTVQGPPGQPGPQGPPGISKVFSAYSNVTADLMDFFQTYGAIQGPPGQKGEMGTPGPKGDRGPAGPPGHPGPPGPRGHKGEKGDKGDQVYAGRRRRRSIAVKP

SEQ ID NO: 19138 - protein, 1415 aa, Homo sapiens
  Payload ID: 3837
  Gene Symbol: COL17A1
  Gene Name: collagen, type XVII, alpha 1
  Uniprot ID: Q9UMD9
  ENSP ID: ENSP00000358748
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEGSSSGNSSPEYPRKEFASSSTRGRSQTRESEIRVRLQSASPSTRWTELDDVKRLLKGSRSASVSPTRNSSNTLPIPKKGTVETKIVTASSQSVSGTYDATILDANLPSHVWSSTLPAGSSMGTYHNNMTTQSSSLLNTNAYSAGSVFGVPNNMASCSPTLHPGLSTSSSVFGMQNNLAPSLTTLSHGTTTTSTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGDLKTVSTKGKTTTADIHSYGSSGGGGSGGGGGVGGAGGGPWGPAPAWCPCGSCCSWWKWLLGLLLTWLLLLGLLFGLIALAEEVRKLKARVDELERIRRSILPYGDSMDRIEKDRLQGMAPAAGADLDKIGLHSDSQEELWMFVRKKLMMEQENGNLRGSPGPKGDMGSPGPKGDRGFPGTPGIPGPLGHPGPQGPKGQKGSVGDPGMEGPMGQRGREGPMGPRGEAGPPGSGEKGERGAAGEPGPHGPPGVPGSVGPKGSSGSPGPQGPPGPVGLQGLRGEVGLPGVKGDKGPMGPPGPKGDQGEKGPRGLTGEPGMRGLPGAVGEPGAKGAMGPAGPDGHQGPRGEQGLTGMPGIRGPPGPSGDPGKPGLTGPQGPQGLPGTPGRPGIKGEPGAPGKIVTSEGSSMLTVPGPPGPPGAMGPPGPPGAPGPAGPAGLPGHQEVLNLQGPPGPPGPRGPPGPSIPGPPGPRGPPGEGLPGPPGPPGSFLSNSETFLSGPPGPPGPPGPKGDQGDPGVPGALGIPSGPSEGGSSSTMYVSGPPGPPGPPGPPGSISSSGQEIQQYISEYMQSDSIRSYLSGVQGPPGPPGPPGPVTTITGETFDYSELASHVVSYLRTSGYGVSLFSSSISSEDILAVLQRDDVRQYLRQYLMGPRGPPGPPGASGDGSLLSLDYAELSSRILSYMSSSGISIGLPGPPGPPGLPGTSYEELLSLLRAAGLSFIPGPPGPPGPPGPRGPPGVSGALATYAAENSDSFRSELISYLTSPDVRSFIVGPPGPPGPQGPPGDSRLLSTDASHSRGSSSSSHSSSVRRGSSYSSSMSTGGGGAGSLGAGGAFGEAAGDRGPYGTDIGPGGGYGAAAEGGMYAGNGGLLGADFAGDLDYNELAVRVSESMQRQGLLQGMAYTVQGPPGQPGPQGPPGISKVFSAYSNVTADLMDFFQTYGAIQGPPGQKGEMGTPGPKGDRGPAGPPGHPGPPGPRGHKGEKGDKGDQVYAGRRRRRSIAVKP

SEQ ID NO: 19139 - protein, 417 aa, Homo sapiens
  Payload ID: 3837
  Gene Symbol: COL17A1
  Gene Name: collagen, type XVII, alpha 1
  ENSP ID: ENSP00000376905
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEGSSSGNSSPEYPRKEFASSSTRGRSQTRESEIRVRLQSASPSTRWTELDDVKRLLKGSRSASVSPTRNSSNTLPIPKKGTVETKIVTASSQSVSGTYDATILDANLPSHVWSSTLPAGSSMGTYHNNMTTQSSSLLNTNAYSAGSVFGVPNNMASCSPTLHPGLSTSSSVFGMQNNLAPSLTTLSHGTTTTSTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGKNKYDCCPP

SEQ ID NO: 19140 - protein, 66 aa, Homo sapiens
  Payload ID: 3837
  Gene Symbol: COL17A1
  Gene Name: collagen, type XVII, alpha 1
  ENSP ID: ENSP00000388832
  MOD_RES (1)..(1): Any amino acid
XYGAIQGPPGQKGEMGTPGPKGDRGPAGPPGHPGPPGPRGHKGEKGDKGDQVYAGRRRRRSIAVKP

SEQ ID NO: 19141 - protein, 687 aa, Homo sapiens
  Payload ID: 3838
  Gene Symbol: COL18A1
  Gene Name: collagen, type XVIII, alpha 1
  ENSP ID: ENSP00000339118
GEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGQVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 19142 - protein, 1519 aa, Homo sapiens
  Payload ID: 3838
  Gene Symbol: COL18A1
  Gene Name: collagen, type XVIII, alpha 1
  Uniprot ID: P39060
  ENSP ID: ENSP00000347665
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 19143 - protein, 1754 aa, Homo sapiens
  Payload ID: 3838
  Gene Symbol: COL18A1
  Gene Name: collagen, type XVIII, alpha 1
  Uniprot ID: P39060
  ENSP ID: ENSP00000352798
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSGRASLSSLLGGAPPWGSLQDPDSQGLSPAAAAPSQQLQRPDVRLRTPLLHPLVMGSLGKHAAPSAFSSGLPGALSQVAVTTLTRDSGAWVSHVANSVGPGLANNSALLGADPEAPAGRCLPLPPSLPVCGHLGISRFWLPNHLHHESGEQVRAGARAWGGLLQTHCHPFLAWFFCLLLVPPCGSVPPPAPPPCCQFCEALQDACWSRLGGGRLPVACASLPTQEDGYCVLIGPAAERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 19144 - protein, 1339 aa, Homo sapiens
  Payload ID: 3838
  Gene Symbol: COL18A1
  Gene Name: collagen, type XVIII, alpha 1
  Uniprot ID: P39060
  ENSP ID: ENSP00000383191
MAPRCPWPWPRRRRLLDVLAPLVLLLGVRAASAEPERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 19145 - protein, 280 aa, Homo sapiens
  Payload ID: 3838
  Gene Symbol: COL18A1
  Gene Name: collagen, type XVIII, alpha 1
  ENSP ID: ENSP00000415692
  MOD_RES (1)..(1): Any amino acid
XISVPGPPGPPGPPGPPGTMGASSGVRLWATRQAMLGQVHEVPEGWLIFVAEQEELYVRVQNGFRKVQDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWR

SEQ ID NO: 19146 - protein, 1284 aa, Homo sapiens
  Payload ID: 3839
  Gene Symbol: COL20A1
  Gene Name: collagen, type XX, alpha 1
  Uniprot ID: Q9P218
  ENSP ID: ENSP00000351767
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPSHTGSPDPEQASEPQVAFTPSQDPRTPAGPQFRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQASHVSKFDSFHENTRPPMPILEQKLEPGTEPLGSPGTRSKALVPGEWGRGGRHLEGRGEPGAVGQMGSPGQQGASTQGLWE

SEQ ID NO: 19147 - protein, 250 aa, Homo sapiens
  Payload ID: 3839
  Gene Symbol: COL20A1
  Gene Name: collagen, type XX, alpha 1
  ENSP ID: ENSP00000406345
ERPLGEMGSPPAAGFVTLGRLAKARGPRSSSAAFQLQMLQIVCSDTWADEDRCCELPASRDGETCPAFVSACSCSSETPGPPGPQGPPGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGG

SEQ ID NO: 19148 - protein, 401 aa, Homo sapiens
  Payload ID: 3839
  Gene Symbol: COL20A1
  Gene Name: collagen, type XX, alpha 1
  ENSP ID: ENSP00000410799
EHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGEPGPPGQMGPEGPGGQQGSPGTQGRAVQGPVGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGGRHLEGR

SEQ ID NO: 19149 - protein, 1297 aa, Homo sapiens
  Payload ID: 3839
  Gene Symbol: COL20A1
  Gene Name: collagen, type XX, alpha 1
  Uniprot ID: Q9P218
  ENSP ID: ENSP00000414753
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPSHTGSPDPEQASEPQVAFTPSQDPRTPGGSEWRETGPQFRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGGRHLEGRGEPGAVGQMGSPGQQGASTQGLWE

SEQ ID NO: 19150 - protein, 957 aa, Homo sapiens
  Payload ID: 3840
  Gene Symbol: COL21A1
  Gene Name: collagen, type XXI, alpha 1
  Uniprot ID: Q96P44
  ENSP ID: ENSP00000244728
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLTKIAVVLTDGKSQDDVKDAAQAARDSKITLFAIGVGSETEDAELRAIANKPSSTYVFYVEDYIAISKIREVMKQKLCEESVCPTRIPVAARDERGFDILLGLDVNKKVKKRIQLSPKKIKGYEVTSKVDLSELTSNVFPEGLPPSYVFVSTQRFKVKKIWDLWRILTIDGRPQIAVTLNGVDKILLFTTTSVINGSQVVTFANPQVKTLFDEGWHQIRLLVTEQDVTLYIDDQQIENKPLHPVLGILINGQTQIGKYSGKEETVQFDVQKLRIYCDPEQNNRETACEIPGFNGECLNGPSDVGSTPAPCICPPGKPGLQGPKGDPGLPGNPGYPGQPGQDGKPGYQGIAGTPGVPGSPGIQGARGLPGYKGEPGRDGDKGDRGLPGFPGLHGMPGSKGEMGAKGDKGSPGFYGKKGAKGEKGNAGFPGLPGPAGEPGRHGKDGLMGSPGFKGEAGSPGAPGQDGTRGEPGIPGFPGNRGLMGQKGEIGPPGQQGKKGAPGMPGLMGSNGSPGQPGTPGSKGSKGEPGIQGMPGASGLKGEPGATGSPGEPGYMGLPGIQGKKGDKGNQGEKGIQGQKGENGRQGIPGQQGIQGHHGAKGERGEKGEPGVRGAIGSKGESGVDGLMGPAGPKGQPGDPGPQGPPGLDGKPGREFSEQFIRQVCTDVIRAQLPVLLQSGRIRNCDHCLSQHGSPGIPGPPGPIGPEGPRGLPGLPGRDGVPGLVGVPGRPGVRGLKGLPGRNGEKGSQGFGYPGEQGPPGPPGPEGPPGISKEGPPGDPGLPGKDGDHGKPGIQGQPGPPGICDPSLCFSVIARRDPFRKGPNY

SEQ ID NO: 19151 - protein, 136 aa, Homo sapiens
  Payload ID: 3840
  Gene Symbol: COL21A1
  Gene Name: collagen, type XXI, alpha 1
  ENSP ID: ENSP00000359853
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLT

SEQ ID NO: 19152 - protein, 954 aa, Homo sapiens
  Payload ID: 3840
  Gene Symbol: COL21A1
  Gene Name: collagen, type XXI, alpha 1
  Uniprot ID: Q96P44
  ENSP ID: ENSP00000359855
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLTKIAVVLTDGKSQDDVKDAAQAARDSKITLFAIGVGSETEDAELRAIANKPSSTYVFYVEDYIAISKIREVMKQKLCEESVCPTRIPVAARDERGFDILLGLDVNKKVKKRIQLSPKKIKGYEVTSKVDLSELTSNVFPEGLPPSYVFVSTQRFKVKKIWDLWRILTIDGRPQIAVTLNGVDKILLFTTTSVINGSQVVTFANPQVKTLFDEGWHQIRLLVTEQDVTLYIDDQQIENKPLHPVLGILINGQTQIGKYSGKEETVQFDVQKLRIYCDPEQNNRETACEIPGFCLNGPSDVGSTPAPCICPPGKPGLQGPKGDPGLPGNPGYPGQPGQDGKPGYQGIAGTPGVPGSPGIQGARGLPGYKGEPGRDGDKGDRGLPGFPGLHGMPGSKGEMGAKGDKGSPGFYGKKGAKGEKGNAGFPGLPGPAGEPGRHGKDGLMGSPGFKGEAGSPGAPGQDGTRGEPGIPGFPGNRGLMGQKGEIGPPGQQGKKGAPGMPGLMGSNGSPGQPGTPGSKGSKGEPGIQGMPGASGLKGEPGATGSPGEPGYMGLPGIQGKKGDKGNQGEKGIQGQKGENGRQGIPGQQGIQGHHGAKGERGEKGEPGVRGAIGSKGESGVDGLMGPAGPKGQPGDPGPQGPPGLDGKPGREFSEQFIRQVCTDVIRAQLPVLLQSGRIRNCDHCLSQHGSPGIPGPPGPIGPEGPRGLPGLPGRDGVPGLVGVPGRPGVRGLKGLPGRNGEKGSQGFGYPGEQGPPGPPGPEGPPGISKEGPPGDPGLPGKDGDHGKPGIQGQPGPPGICDPSLCFSVIARRDPFRKGPNY

SEQ ID NO: 19153 - protein, 125 aa, Homo sapiens
  Payload ID: 3840
  Gene Symbol: COL21A1
  Gene Name: collagen, type XXI, alpha 1
  ENSP ID: ENSP00000390958
  MOD_RES (1)..(1): Any amino acid
XRETACEIPGFNGECLNGPSDVGSTPAPCICPPGKPGLQGPKGYQGIAGTPGVPGSPGIQGARGLPGYKGEPGRDGDKGDRGLPGFPGLHGMPGSKGEMGAKGDKGSPGFYGKKGSIDHTTKYSY

SEQ ID NO: 19154 - protein, 79 aa, Homo sapiens
  Payload ID: 3840
  Gene Symbol: COL21A1
  Gene Name: collagen, type XXI, alpha 1
  ENSP ID: ENSP00000433624
AKGDKGSPGFYGKKGAKGEKGNAGFPGLPGPAGEPGRHGKDGLMGSPGFKGEAGSPGAPGQDGTRGEPTCAYEFSHVKE

SEQ ID NO: 19155 - protein, 956 aa, Homo sapiens [sequence omitted]

SEQ ID NO: 19156 - protein, 1626 aa, Homo sapiens
  Payload ID: 3841
  Gene Symbol: COL22A1
  Gene Name: collagen, type XXII, alpha 1
  Uniprot ID: Q8NFW1
  ENSP ID: ENSP00000303153
MAGLRGNAVAGLLWMLLLWSGGGGCQAQRAGCKSVHYDLVFLLDTSSSVGKEDFEKVRQWVANLVDTFEVGPDRTRVGVVRYSDRPTTAFELGLFGSQEEVKAAARRLAYHGGNTNTGDALRYITARSFSPHAGGRPRDRAYKQVAILLTDGRSQDLVLDAAAAAHRAGIRIFAVGVGEALKEELEEIASEPKSAHVFHVSDFNAIDKIRGKLRRRLCENVLCPSVRVEGDRFKHTNGGTKEITGFDLMDLFSVKEILGKRENGAQSSYVRMGSFPVVQSTEDVFPQGLPDEYAFVTTFRFRKTSRKEDWYIWQVIDQYSIPQVSIRLDGENKAVEYNAVGAMKDAVRVVFRGSRVNDLFDRDWHKMALSIQAQNVSLHIDCALVQTLPIEERENIDIQGKTVIGKRLYDSVPIDFDLQRIVIYCDSRHAELETCCDIPSGPCQVTVVTEPPPPPPPQRPPTPGSEQIGFLKTINCSCPAGEKGEMGVAGPMGLPGPKGDIGAIGPVGAPGPKGEKGDVGIGPFGQGEKGEKGSLGLPGPPGRDGSKGMRGEPGELGEPGLPGEVGMRGPQGPPGLPGPPGRVGAPGLQGERGEKGTRGEKGERGLDGFPGKPGDTGQQGRPGPSGVAGPQGEKGDVGPAGPPGVPGSVVQQEGLKGEQGAPGPRGHQGAPGPPGARGPIGPEGRDGPPGLQGLRGKKGDMGPPGIPGLLGLQGPPGPPGVPGPPGPGGSPGLPGEIGFPGKPGPPGPTGPPGKDGPNGPPGPPGTKGEPGERGEDGLPGKPGLRGEIGEQGLAGRPGEKGEAGLPGAPGFPGVRGEKGDQGEKGELGLPGLKGDRGEKGEAGPAGPPGLPGTTSLFTPHPRMPGEQGPKGEKGDPGLPGEPGLQGRPGELGPQGPTGPPGAKGQEGAHGAPGAAGNPGAPGHVGAPGPSGPPGSVGAPGLRGTPGKDGERGEKGAAGEEGSPGPVGPRGDPGAPGLPGPPGKGKDGEPGLRGSPGLPGPLGTKAACGKVRGSENCALGGQCVKGDRGAPGIPGSPGSRGDPGIGVAGPPGPSGPPGDKGSPGSRGLPGFPGPQGPAGRDGAPGNPGERGPPGKPGLSSLLSPGDINLLAKDVCNDCPPGPPGLPGLPGFKGDKGVPGKPGREGTEGKKGEAGPPGLPGPPGIAGPQGSQGERGADGEVGQKGDQGHPGVPGFMGPPGNPGPPGADGIAGAAGPPGIQGSPGKEGPPGPQGPSGLPGIPGEEGKEGRDGKPGPPGEPGKAGEPGLPGPEGARGPPGFKGHTGDSGAPGPRGESGAMGLPGQEGLPGKDGDTGPTGPQGPQGPRGPPGKNGSPGSPGEPGPSGTPGQKGSKGENGSPGLPGFLGPRGPPGEPGEKGVPGKEGVPGKPGEPGFKGERGDPGIKGDKGPPGGKGQPGDPGIPGHKGHTGLMGPQGLPGENGPVGPPGPPGQPGFPGLRGESPSMETLRRLIQEELGKQLETRLAYLLAQMPPAYMKSSQGRPGPPGPPGKDGLPGRAGPMGEPGRPGQGGLEGPSGPIGPKGERGAKGDPGAPGVGLRGEMGPPGIPGQPGEPGYAKDGLPGIPGPQGETGPAGHPGLPGPPGPPGQCDPSQCAYFASLAARPGNVKGP

SEQ ID NO: 19157 - protein, 1319 aa, Homo sapiens
  Payload ID: 3841
  Gene Symbol: COL22A1
  Gene Name: collagen, type XXII, alpha 1
  Uniprot ID: Q8NFW1
  ENSP ID: ENSP00000387655
MAGLRGNAVAGLLWMLLLWSGGGGCQAQRAGCKSVHYDLVFLLDTSSSVGKEDFEKVRQWVANLVDTFEVGPDRTRVGVVRYSDRPTTAFELGLFGSQEEVKAAARRLAYHGGNTNTGDALRYITARSFSPHAGGRPRDRAYKQVAILLTDGRSQDLVLDAAAAAHRAGIRIFAVGVGEALKEELEEIASEPKSAHVFHVSDFNAIDKIRGKLRRRLCENVLCPSVRVEGDRFKHTNGGTKEITGFDLMDLFSVKEILGKRENGAQSSYVRMGSFPVVQSTEDVFPQGLPDEYAFVTTFRFRKTSRKEDWYIWQVIDQYSIPQVSIRLDGENKAVEYNAVAGPQGEKGDVGPAGPPGVPGSVVQQEGLKGEQGAPGPRGHQGAPGPPGARGPIGPEGRDGPPGLQGLRGKKGDMGPPGIPGLLGLQGPPGPPGVPGPPGPGGSPGLPGEIGFPGKPGPPGPTGPPGKDGPNGPPGPPGTKGEPGERGEDGLPGKPGLRGEIGEQGLAGRPGEKGEAGLPGAPGFPGVRGEKGDQGEKGELGLPGLKGDRGEKGEAGPAGPPGLPGTTSLFTPHPRMPGEQGPKGEKGDPGLPGEPGLQGRPGELGPQGPTGPPGAKGQEGAHGAPGAAGNPGAPGHVGAPGPSGPPGSVGAPGLRGTPGKDGERGEKGAAGEEGSPGPVGPRGDPGAPGLPGPPGKGKDGEPGLRGSPGLPGPLGTKGDRGAPGIPGSPGSRGDPGIGVAGPPGPSGPPGDKGSPGSRGLPGFPGPQGPAGRDGAPGNPGERGPPGKPGLSSLLSPGDINLLAKDVCNDCPPGPPGLPGLPGFKGDKGVPGKPGREGTEGKKGEAGPPGLPGPPGIAGPQGSQGERGADGEVGQKGDQGHPGVPGFMGPPGNPGPPGADGIAGAAGPPGIQGSPGKEGPPGPQGPSGLPGIPGEEGKEGRDGKPGPPGEPGKAGEPGLPGPEGARGPPGFKGHTGDSGAPGPRGESGAMGLPGQEGLPGKDGDTGPTGPQGPQGPRGPPGKNGSPGSPGEPGPSGTPGQKGSKGENGSPGLPGFLGPRGPPGEPGEKGVPGKEGVPGKPGEPGFKGERGDPGIKGDKGPPGGKGQPGDPGIPGHKGHTGLMGPQGLPGENGPVGPPGPPGQPGFPGLRGESPSMETLRRLIQEELGKQLETRLAYLLAQMPPAYMKSSQGRPGPPGPPGKDGLPGRAGPMGEPGRPGQGGLEGPSGPIGPKGERGAKGDPGAPGVGLRGEMGPPGIPGQPGEPGYAKDGLPGIPGPQGETGPAGHPGLPGPPGPPGQCDPSQCAYFASLAARPGNVKGP

SEQ ID NO: 19158 - protein, 65 aa, Homo sapiens
  Payload ID: 3841
  Gene Symbol: COL22A1
  Gene Name: collagen, type XXII, alpha 1
  ENSP ID: ENSP00000428244
GEPGELGEPGLPGEVGMRGPQGPPGLPGPPGRVGAPVSEGTCLGRGSTPSPGIKNQVLASSSTCI

SEQ ID NO: 19159 - protein, 540 aa, Homo sapiens
  Payload ID: 3842
  Gene Symbol: COL23A1
  Gene Name: collagen, type XXIII, alpha 1
  Uniprot ID: Q86Y22
  ENSP ID: ENSP00000375069
MGPGERAGGGGDAGKGNAAGGGGGGRSATTAGSRAVSALCLLLSVGSAAACLLLGVQAAALQGRVAALEEERELLRRAGPPGALDAWAEPHLERLLREKLDGLAKIRTAREAPSECVCPPGPPGRRGKPGRRGDPGPPGQSGRDGYPGPLGLDGKPGLPGPKGEKGAPGDFGPRGDQGQDGAAGPPGPPGPPGARGPPGDTGKDGPRGAQGPAGPKGEPGQDGEMGPKGPPGPKGEPGVPGKKGDDGTPSQPGPPGPKGEPGSMGPRGENGVDGAPGPKGEPGHRGTDGAAGPRGAPGLKGEQGDTVVIDYDGRILDALKGPPGPQGPPGPPGIPGAKGELGLPGAPGIDGEKGPKGQKGDPGEPGPAGLKGEAGEMGLSGLPGADGLKGEKGESASDSLQESLAQLIVEPGPPGPPGPPGPMGLQGIQGPKGLDGAKGEKGASGERGPSGLPGPVGPPGLIGLPGTKGEKGRPGEPGLDGFPGPRGEKGDRSERGEKGERGVPGRKGVKGQKGEPGPPGLDQPCPVGPDGLPVPGCWHK

SEQ ID NO: 19160 - protein, 393 aa, Homo sapiens [sequence omitted]

SEQ ID NO: 19161 - protein, 1714 aa, Homo sapiens
  Payload ID: 3843
  Gene Symbol: COL24A1
  Gene Name: collagen, type XXIV, alpha 1
  Uniprot ID: Q17RW2
  ENSP ID: ENSP00000359603
MHLRAHRTRRGKVSPTAKTKSLLHFIVLCVAGVVVHAQEQGIDILHQLGLGGKDVRHSSPATAVPSASTPLPQGVHLTESGVIFKNDAYIETPFVKILPVNLGQPFTILTGLQSHRVNNAFLFSIRNKNRLQLGVQLLPKKLVVHIRGKQPAVFNYSVHDEQWHSFAITIRNQSVSMFVECGKKYFSTETIPEVQTFDSNSVFTLGSMNNNSIHFEGIVCQLDIIPSAEASADYCRYVKQQCRQADKYQPETSIPCTTLIPTKIPEHSPPPKLFAEKVLSEDTFTEGKSIPNIIKNDSETVYKRQEHQISRSQLSSLQSGNVSAVDLTNHGIQAKEMITEEDTQTNFSLSVTTHRISEAKMNTKEKFSSLLNMSDNITQHDDRVTGLSLFKKMPSILPQIKQDTITNLKKAITANLHTNELMEMQPILNTSLHRVTNEPSVDNHLDLRKEGEFYPDATYPIENSYETELYDYYYYEDLNTMLEMEYLRGPKGDTGPPGPPGPAGIPGPSGKRGPRGIPGPHGNPGLPGLPGPKGPKGDPGFSPGQPVPGEKGDQGLSGLMGPPGMQGDKGLKGHPGLPGLPGEQGIPGFAGNIGSPGYPGRQGLAGPEGNPGPKGAQGFIGSPGEAGQLGPEGERGIPGIRGKKGFKGRQGFPGDFGDRGPAGLDGSPGLVGGTGPPGFPGLRGSVGPVGPIGPAGIPGPMGLSGNKGLPGIKGDKGEQGTAGELGEPGYPGDKGAVGLPGPPGMRGKSGPSGQTGDPGLQGPSGPPGPEGFPGDIGIPGQNGPEGPKGLLGNRGPPGPPGLKGTQGEEGPIGAFGELGPRGKPGQKGYAGEPGPEGLKGEVGDQGNIGKIGETGPVGLPGEVGMTGSIGEKGERGSPGPLGPQGEKGVMGYPGPPGVPGPIGPLGLPGHVGARGPPGSQGPKGQRGSRGPDGLLGEQGIQGAKGEKGDQGKRGPHGLIGKTGNPGERGFQGKPGLQGLPGSTGDRGLPGEPGLRGLQGDVGPPGEMGMEGPPGTEGESGLQGEPGAKGDVGTAGSVGGTGEPGLRGEPGAPGEEGLQGKDGLKGVPGGRGLPGEDGEKGEMGLPGIIGPLGRSGQTGLPGPEGIVGIPGQRGRPGKKGDKGQIGPTGEVGSRGPPGKIGKSGPKGARGTRGAVGHLGLMGPDGEPGIPGYRGHQGQPGPSGLPGPKGEKGYPGEDSTVLGPPGPRGEPGPVGDQGERGEPGAEGYKGHVGVPGLRGATGQQGPPGEPGDQGEQGLKGERGSEGNKGKKGAPGPSGKPGIPGLQGLLGPKGIQGYHGADGISGNPGKIGPPGKQGLPGIRGGPGRTGLAGAPGPPGVKGSSGLPGSPGIQGPKGEQGLPGQPGIQGKRGHRGAQGDQGPCGDPGLKGQPGEYGVQGLTGFQGFPGPKGPEGDAGIVGISGPKGPIGHRGNTGPLGREGIIGPTGRTGPRGEKGFRGETGPQGPRGQPGPPGPPGAPGPRKQMDINAAIQALIESNTALQMESYQNTEVTLIDHSEEIFKTLNYLSNLLHSIKNPLGTRDNPARICKDLLNCEQKVSDGKYWIDPNLGCPSDAIEVFCNFSAGGQTCLPPVSVTKLEFGVGKVQMNFLHLLSSEATHIITIHCLNTPRWTSTQTSGPGLPIGFKGWNGQIFKVNTLLEPKVLSDDCKIQDGSWHKATFLFHTQEPNQLPVIEVQKLPHLKTERKYYIDSSSVCFL

SEQ ID NO: 19162 - protein, 890 aa, Homo sapiens
  Payload ID: 3843
  Gene Symbol: COL24A1
  Gene Name: collagen, type XXIV, alpha 1
  ENSP ID: ENSP00000409515
MHLRAHRTRRGKVSPTAKTKSLLHFIVLCVAGVVVHAQEQGIDILHQLGLGGKDVRHSSPATAVPSASTPLPQGVHLTESGVIFKNDAYIETPFVKILPVNLGQPFTILTGLQSHRVNNAFLFSIRNKNRLQLGVQLLPKKLVVHIRGKQPAVFNYSVHDEQWHSFAITIRNQSVSMFVECGKKYFSTETIPEVQTFDSNSVFTLGSMNNNSIHFEGIVCQLDIIPSAEASADYCRYVKQQCRQADKYQPETSIPCTTLIPTKIPEHSPPPKLFAEKVLSEDTFTEGKSIPNIIKNDSETVYKRQEHQISRSQLSSLQSGNVSAVDLTNHGIQAKEMITEEDTQTNFSLSVTTHRISEAKMNTKEKFSSLLNMSDNITQHDDRVTGLSLFKKMPSILPQIKQDTITNLKKAITANLHTNELMEMQPILNTSLHRVTNEPSVDNHLDLRKEGEFYPDATYPIENSYETELYDYYYYEDLNTMLEMEYLRGPKGDTGPPGPPGPAGIPGPSGKRGPRGIPGPHGNPGLPGLPGPKGPKGDPGFSPGQPVPGEKGDQGLSGLMGPPGMQGDKGLKGHPGLPGLPGEQGIPGFAGNIGSPGYPGRQGLAGPEGNPGPKGAQGFIGSPGEAGQLGPEGERGIPGIRGKKGFKGRQGFPGDFGDRGPAGLDGSPGLVGGTGPPGFPGLRGSVGPVGPIGPAGIPGPMGLSGNKGLPGIKGDKGEQGTAGELGEPGYPGDKGAVGLPGPPGMRGKSGPSGQTGDPGLQGPSGPPGPEGFPGDIGIPGQNGPEGPKGLLGNRGPPGPPGLKGTQGEEGPIGAFGELGPRGKPGQKGYAGEPGPEGLKGEVGDQGNIGKIGETMESCSVTQAGAQWHDLGSLHPLPPGFKRFSCLSLPG

SEQ ID NO: 19163 - protein, 166 aa, Homo sapiens
  Payload ID: 3843
  Gene Symbol: COL24A1
  Gene Name: collagen, type XXIV, alpha 1
  ENSP ID: ENSP00000432605
  MOD_RES (1)..(1): Any amino acid
XIKNPLGTRDNPARICKDLLNCEQKVSDGKYWIDPNLGCPSDAIEVFCNFSAGGQTCLPPVSVTKAFTIITPEIEEGRILPFLGNHEPLIKSSMIVLLPKYPHHHPHSSGSWHRIIIEGKKMGLCELCRGNRSSGEADSSCFHDQITSLISLIHKLNPRKTREVLG

SEQ ID NO: 19164 - protein, 81 aa, Homo sapiens
  Payload ID: 3843
  Gene Symbol: COL24A1
  Gene Name: collagen, type XXIV, alpha 1
  ENSP ID: ENSP00000434740
MHLRAHRTRRGKVSPTAKTKSLLHFIVLCVAGVVVHAQEQGIDILHQLGLGGKDVRHSSPATAVPSASTPLPQGVHLTESG

SEQ ID NO: 19165 - protein, 642 aa, Homo sapiens
  Payload ID: 3844
  Gene Symbol: COL25A1
  Gene Name: collagen, type XXV, alpha 1
  Uniprot ID: Q9BXS0
  ENSP ID: ENSP00000382077
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPGKDGEPGLDGFPGPRGEKGDLGEKGEKVTSPSQHVPCLILLLLSALLFSLCDSI

SEQ ID NO: 19166 - protein, 645 aa, Homo sapiens
  Payload ID: 3844
  Gene Symbol: COL25A1
  Gene Name: collagen, type XXV, alpha 1
  ENSP ID: ENSP00000382078
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRGLPGFPTVAALHSNQILTVKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGDRGEKGDSGAQGPRGPPGQKGDQGATEIIDYNGNLHEALQGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGEPGLNGVKGLKGEPGQKGDRGPLGLPGASGLDGKPGSRGTDGPMGPHGPAGPKGERGEKGAMGEPGPRGPYGLPGFPGPRGEKGDLGEKGEKVTSPSQHVPCLILLLLSALLFSLCDSI

SEQ ID NO: 19167 - protein, 654 aa, Homo sapiens
  Payload ID: 3844
  Gene Symbol: COL25A1
  Gene Name: collagen, type XXV, alpha 1
  Uniprot ID: Q9BXS0
  ENSP ID: ENSP00000382083
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPGKDGEPGLDGFPGPRGEKGDLGEKGEKGFRGVKGEKGEPGQPGLDGLDAPCQLGPDGLPMPGCWQK

SEQ ID NO: 19168 - protein, 70 aa, Homo sapiens
  Payload ID: 3844
  Gene Symbol: COL25A1
  Gene Name: collagen, type XXV, alpha 1
  ENSP ID: ENSP00000422266
MLLKKHAGKGGGREPRSEDPTPAEQHCARTMPPCAVLAALLSVVAVVSCLYLGVKTNDLQARIAALESAK

SEQ ID NO: 19169 - protein, 29 aa, Homo sapiens
  Payload ID: 3844
  Gene Symbol: COL25A1
  Gene Name: collagen, type XXV, alpha 1
  ENSP ID: ENSP00000426841
  MOD_RES (1)..(1): Any amino acid
XGPRGEKGDLGEKGEKGPDGLPMPGCWQK

SEQ ID NO: 19170 - protein, 496 aa, Homo sapiens
  Payload ID: 3844
  Gene Symbol: COL25A1
  Gene Name: collagen, type XXV, alpha 1
  ENSP ID: ENSP00000437131
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGSQWNERRKRRFWNAGSTGSFYHRPTRPTRSPWPTWPHGTSWTSWTKGSIWLRRKARIPGYRWSYGTPWPCRSQRRKR

SEQ ID NO: 19171 - protein, 333 aa, Homo sapiens [sequence omitted]

SEQ ID NO: 19172 - protein, 494 aa, Homo sapiens [sequence omitted]

SEQ ID NO: 19173 - protein, 441 aa, Homo sapiens
  Payload ID: 3845
  Gene Symbol: COL26A1
  Gene Name: collagen, type XXVI, alpha 1
  Uniprot ID: Q96A83
  ENSP ID: ENSP00000318234
MKLALLLPWACCCLCGSALATGFLYPFSAAALQQHGYPEPGAGSPGSGYASRRHWCHHTVTRTVSCQVQNGSETVVQRVYQSCRWPGPCANLVSYRTLIRPTYRVSYRTVTVLEWRCCPGFTGSNCDEECMNCTRLSDMSERLTTLEAKVLLLEAAERPSSPDNDLPAPESTPPTWNEDFLPDAIPLAHPVPRQRRPTGPAGPPGQTGPPGPAGPPGSKGDRGQTGEKGPAGPPGLLGPPGPRGLPGEMGRPGPPGPPGPAGNPGPSPNSPQGALYSLQPPTDKDNGDSRLASAIVDTVLAGVPGPRGPPGPPGPPGPRGPPGPPGTPGSQGLAGERGTVGPSGEPGVKGEEGEKAATAEGEGVQQLREALKILAERVLILEHMIGIHDPLASPEGGSGQDAALRANLKMKRGGAQPDGVLAALLGPDPGQKSVDQASSRK

SEQ ID NO: 19174 - protein, 439 aa, Homo sapiens
  Payload ID: 3845
  Gene Symbol: COL26A1
  Gene Name: collagen, type XXVI, alpha 1
  Uniprot ID: Q96A83
  ENSP ID: ENSP00000482102
MKLALLLPWACCCLCGSALATGFLYPFSAAALQQHGYPEPGAGSPGSGYASRRHWCHHTVTRTVSCQVQNGSETVVQRVYQSCRWPGPCANLVRTLIRPTYRVSYRTVTVLEWRCCPGFTGSNCDEECMNCTRLSDMSERLTTLEAKVLLLEAAERPSSPDNDLPAPESTPPTWNEDFLPDAIPLAHPVPRQRRPTGPAGPPGQTGPPGPAGPPGSKGDRGQTGEKGPAGPPGLLGPPGPRGLPGEMGRPGPPGPPGPAGNPGPSPNSPQGALYSLQPPTDKDNGDSRLASAIVDTVLAGVPGPRGPPGPPGPPGPRGPPGPPGTPGSQGLAGERGTVGPSGEPGVKGEEGEKAATAEGEGVQQLREALKILAERVLILEHMIGIHDPLASPEGGSGQDAALRANLKMKRGGAQPDGVLAALLGPDPGQKSVDQASSRK

SEQ ID NO: 19175 - protein, 1860 aa, Homo sapiens
  Payload ID: 3846
  Gene Symbol: COL27A1
  Gene Name: collagen, type XXVII, alpha 1
  Uniprot ID: Q8IZC6
  ENSP ID: ENSP00000348385
MGAGSARGARGTAAAAAARGGGFLFSWILVSFACHLASTQGAPEDVDILQRLGLSWTKAGSPAPPGVIPFQSGFIFTQRARLQAPTGTVIPAALGTELALVLSLCSHRVNHAFLFAVRSQKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGQKGDPGLSPGKAHDGAKGDMGLPGLSGNPGPPGRKGHKGYPGPAGHPGEQGQPGPEGSPGAKGYPGRQGLPGPVGDPGPKGSRGYIGLPGLFGLPGSDGERGLPGVPGKRGKMGMPGFPGVFGERGPPGLDGNPGELGLPGPPGVPGLIGDLGVLGPIGYPGPKGMKGLMGSVGEPGLKGDKGEQGVPGVSGDPGFQGDKGSQGLPGFPGARGKPGPLGKVGDKGSIGFPGPPGPEGFPGDIGPPGDNGPEGMKGKPGARGLPGPRGQLGPEGDEGPMGPPGAPGLEGQPGRKGFPGRPGLDGVKGEPGDPGRPGPVGEQGFMGFIGLVGEPGIVGEKGDRGMMGPPGVPGPKGSMGHPGMPGGMGTPGEPGPQGPPGSRGPPGMRGAKGRRGPRGPDGPAGEQGSRGLKGPPGPQGRPGRPGQQGVAGERGHLGSRGFPGIPGPSGPPGTKGLPGEPGPQGPQGPIGPPGEMGPKGPPGAVGEPGLPGEAGMKGDLGPLGTPGEQGLIGQRGEPGLEGDSGPMGPDGLKGDRGDPGPDGEHGEKGQEGLMGEDGPPGPPGVTGVRGPEGKSGKQGEKGRTGAKGAKGYQGQLGEMGVPGDPGPPGTPGPKGSRGSLGPTGAPGRMGAQGEPGLAGYDGHKGIVGPLGPPGPKGEKGEQGEDGKAEGPPGPPGDRGPVGDRGDRGEPGDPGYPGQEGVQGLRGKPGQQGQPGHPGPRGWPGPKGSKGAEGPKGKQGKAGAPGRRGVQGLQGLPGPRGVVGRQGLEGIAGPDGLPGRDGQAGQQGEQGDDGDPGPMGPAGKRGNPGVAGLPGAQGPPGFKGESGLPGQLGPPGKRGTEGRTGLPGNQGEPGSKGQPGDSGEMGFPGMAGLFGPKGPPGDIGFKGIQGPRGPPGLMGKEGIVGPLGILGPSGLPGPKGDKGSRGDWGLQGPRGPPGPRGRPGPPGPPGGPIQLQQDDLGAAFQTWMDTSGALRPESYSYPDRLVLDQGGEIFKTLHYLSNLIQSIKTPLGTKENPARVCRDLMDCEQKMVDGTYWVDPNLGCSSDTIEVSCNFTHGGQTCLKPITASKVEFAISRVQMNFLHLLSSEVTQHITIHCLNMTVWQEGTGQTPAKQAVRFRAWNGQIFEAGGQFRPEVSMDGCKVQDGRWHQTLFTFRTQDPQQLPIISVDNLPPASSGKQYRLEVGPACFL

SEQ ID NO: 19176 - protein, 714 aa, Homo sapiens
  Payload ID: 3846
  Gene Symbol: COL27A1
  Gene Name: collagen, type XXVII, alpha 1
  ENSP ID: ENSP00000391328
LSWTKAGSPAPPGVIPFQSGFIFTQRARLQAPTGTVIPAALGTELALVLSLCSHRVNHAFLFAVRSQKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGDMGLPGLSGNPGPPGRKGLPGPVGDPGPKGSRGYIGLPGLFGLPGSDGERGLPGVPGKRGKMGMPVLLPQSSEARGGNSMPSEGALAGRHGSHL

SEQ ID NO: 19177 - protein, 485 aa, Homo sapiens
  Payload ID: 3846
  Gene Symbol: COL27A1
  Gene Name: collagen, type XXVII, alpha 1
  ENSP ID: ENSP00000432928
  MOD_RES (1)..(1): Any amino acid
XAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGDMGLPGLSGNPGPPGRKGHKGYPGPAGHPGEQGQPGPEGSPGAKGYPGRQGLPGPVGDPGPKGSRGYIGLPGLFGLPGSDGERGLPGVPGKRGKMGMPGFPGVFGERGPPGLDGNPGELGLPGPPGVPGLIGDLGVLGPIGYPGPKGMKGLMGSVGEPGLKG

SEQ ID NO: 19178 - protein, 1125 aa, Homo sapiens
  Payload ID: 3847
  Gene Symbol: COL28A1
  Gene Name: collagen, type XXVIII, alpha 1
  Uniprot ID: Q2UY09
  ENSP ID: ENSP00000382356
MWNRYFVFYLLLLSAFTSQTVSGQRKKGPKSNLLARKSDVQGSICFIDIVFIVDSSESSKIALFDKQKDFVDSLSDKIFQLTPGRSLEYDIKLAALQFSSSVQIDPPFSSWKDLQTFKQKVKSMNLIGQGTFSYYAISNATRLLKREGRKDGVKVVLLMTDGIDHPKNPDVQSISEDARISGISFITIALSTVVNEAKLRLISGDSSSEPTLLLSDPTLVDKIQDRLDILFEKKCERKICECEKGDPGDPGPPGTHGNPGIKGERGPKGNPGNAQKGEAGERGPGGIPGYKGDKGERGECGKPGIKGDKGSPGPYGPKGPRGIQGITGPPGDPGPKGFQGNKGEPGPPGPYGSPGAPGIGQQGIKGERGQEGRPGAPGPIGVGEPGQPGPRGPEGVPGERGLPGEGFPGPKGEKGSEGPTGPQGLQGLSIKGEKGDIGPVGPQGPMGIPGIGSQGEQGIQGPIGPPGPQGPAGQGLPGSKGEVGQMGPTGPRGPVGIGVQGPKGEPGSIGLPGQPGVPGEDGAAGKKGEAGLPGARGPEGPPGKGQPGPKGDEGKKGSKGNQGQRGLPGPEGPKGEPGIMGPFGMPGTSIPGPPGPKGDRGGPGIPGFKGEPGLSIRGPKGVQGPRGPVGAPGLKGDGYPGVPGPRGLPGPPGPMGLRGVGDTGAKGEPGVRGPPGPSGPRGVGTQGPKGDTGQKGLPGPPGPPGYGSQGIKGEQGPQGFPGPKGTMGHGLPGQKGEHGERGDVGKKGDKGEIGEPGSPGKQGLQGPKGDLGLTKEEIIKLITEICGCGPKCKETPLELVFVIDSSESVGPENFQIIKNFVKTMADRVALDLATARIGIINYSHKVEKVANLKQFSSKDDFKLAVDNMQYLGEGTYTATALQAANDMFEDARPGVKKVALVITDGQTDSRDKEKLTEVVKNASDTNVEIFVIGVVKKNDPNFEIFHKEMNLIATDPEHVYQFDDFFTLQDTLKQKLFQKICEDFDSYLVQIFGSSSPQPGFGMSGEELSESTPEPQKEISESLSVTRDQDEDDKAPEPTWADDLPATTSSEATTTPRPLLSTPVDGAEDPRCLEALKPGNCGEYVVRWYYDKQVNSCARFWFSGCNGSGNRFNSEKECQETCIQG

SEQ ID NO: 19179 - protein, 80 aa, Homo sapiens
  Payload ID: 3847
  Gene Symbol: COL28A1
  Gene Name: collagen, type XXVIII, alpha 1
  ENSP ID: ENSP00000391380
ATTSSEATTTPRPLLSTPVDGAEDPRCLEALKPGNCGEYVVRWYYDKQVNSCARFWFSGCNGSGNRFNSEKECQETCIQG

SEQ ID NO: 19180 - protein, 67 aa, Homo sapiens
  Payload ID: 3847
  Gene Symbol: COL28A1
  Gene Name: collagen, type XXVIII, alpha 1
  ENSP ID: ENSP00000408401
KGNPGNAQKGEAGERGPGGIPGYKGDKQYSREDREVEHNNEKYVACLLPSPALLQQSSLTHHGTCSH

SEQ ID NO: 19181 - protein, 130 aa, Homo sapiens
  Payload ID: 3847
  Gene Symbol: COL28A1
  Gene Name: collagen, type XXVIII, alpha 1
  ENSP ID: ENSP00000410557
GMPGTSIPGPPGPKGDRGGPGIPGFKGEPGLSIRGPKGVQGPRGPVGAPGLKGDGYPGVPGPRGLPGPPGPMGLRGVGDTGAKTLNTSHGLEDPSCPDCSFCHFSLAADIQPKWPALLQLIPASGTRQDG

SEQ ID NO: 19182 - protein, 142 aa, Homo sapiens
  Payload ID: 3847
  Gene Symbol: COL28A1
  Gene Name: collagen, type XXVIII, alpha 1
  ENSP ID: ENSP00000413093
FDSYLVQIFGSSSPQPGFGMSGEELSESTPEPQKEISESLSVTRDQDEDDKAPEPTWADDLPATTSSEATTTPRPLLSTPVDGAEDPRCLEALKPGNCGEYVVRWYYDKQVNSCARFWFSGCNGSGNRFNSEKECQETCIQG

SEQ ID NO: 19183 - protein, 445 aa, Homo sapiens
  Payload ID: 3848
  Gene Symbol: COLQ
  Gene Name: collagen-like tail subunit (single strand of homotrimer)  of asymmetric acetylcholinesterase
  Uniprot ID: Q9Y215
  ENSP ID: ENSP00000373291
MTGSSFSLAHLLIISGLLCYSAGCLALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRCHRAYCGDGHRHEGVEDCDGSDFGYLTCETYLPGSYGDLQCTQYCYIDSTPCRYFT

SEQ ID NO: 19184 - protein, 421 aa, Homo sapiens
  Payload ID: 3848
  Gene Symbol: COLQ
  Gene Name: collagen-like tail subunit (single strand of homotrimer)  of asymmetric acetylcholinesterase
  Uniprot ID: Q9Y215
  ENSP ID: ENSP00000373296
MVVLNPMTLGIYLQLFFLSIVSQPTFINSVLPISAALPSLDQKKRGGHKACCLLTPPPPPLFPPPFFRGGRSPGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRCHRAYCGDGHRHEGVEDCDGSDFGYLTCETYLPGSYGDLQCTQYCYIDSTPCRYFT

SEQ ID NO: 19185 - protein, 455 aa, Homo sapiens
  Payload ID: 3848
  Gene Symbol: COLQ
  Gene Name: collagen-like tail subunit (single strand of homotrimer)  of asymmetric acetylcholinesterase
  Uniprot ID: Q9Y215
  ENSP ID: ENSP00000373298
MVVLNPMTLGIYLQLFFLSIVSQPTFINSVLPISAALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRCHRAYCGDGHRHEGVEDCDGSDFGYLTCETYLPGSYGDLQCTQYCYIDSTPCRYFT

SEQ ID NO: 19186 - protein, 456 aa, Homo sapiens
  Payload ID: 3848
  Gene Symbol: COLQ
  Gene Name: collagen-like tail subunit (single strand of homotrimer)  of asymmetric acetylcholinesterase
  ENSP ID: ENSP00000474271
MVVLNPMTLGIYLQLFFLSIVSQPTFINSVLPISAALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRDCHRAYCGDGHRHEGVEDCDGSDFGYLTCETYLPGSYGDLQCTQYCYIDSTPCRYFT

SEQ ID NO: 19187 - protein, 194 aa, Homo sapiens
  Payload ID: 3848
  Gene Symbol: COLQ
  Gene Name: collagen-like tail subunit (single strand of homotrimer)  of asymmetric acetylcholinesterase
  ENSP ID: ENSP00000474936
ISGLLCYSAGCLALPSLDQKKRGGHKACCLLTPPPPPLFPPPFFRGGRSPGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPP

SEQ ID NO: 19188 - protein, 686 aa, Homo sapiens
  Payload ID: 3849
  Gene Symbol: CRMP1
  Gene Name: collapsin response mediator protein 1
  Uniprot ID: Q14194
  ENSP ID: ENSP00000321606
MADRRRAWNTEDDLPVYLARPGSAAQTPRQKYGGMFAAVEGAYENKTIDFDAYSVGRRGSARTPRSAGRPDAVGLPGPGGSEDTASDVSEPSGSAVSSPGERDERPPTLRIRRPAPRDLPLGRDNGQSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 19189 - protein, 572 aa, Homo sapiens
  Payload ID: 3849
  Gene Symbol: CRMP1
  Gene Name: collapsin response mediator protein 1
  Uniprot ID: Q14194
  ENSP ID: ENSP00000380987
MSYQGKKSIPHITSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 19190 - protein, 570 aa, Homo sapiens
  Payload ID: 3849
  Gene Symbol: CRMP1
  Gene Name: collapsin response mediator protein 1
  ENSP ID: ENSP00000425742
MQKMNNEVVDKSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 19191 - protein, 277 aa, Homo sapiens
  Payload ID: 3850
  Gene Symbol: COLEC10
  Gene Name: collectin sub-family member 10 (C-type lectin)
  Uniprot ID: Q9Y6Z7
  ENSP ID: ENSP00000332723
MNGFASLLRRNQFILLVLFLLQIQSLGLDIDSRPTAEVCATHTISPGPKGDDGEKGDPGEEGKHGKVGRMGPKGIKGELGDMGDQGNIGKTGPIGKKGDKGEKGLLGIPGEKGKAGTVCDCGRYRKFVGQLDISIARLKTSMKFVKNVIAGIRETEEKFYYIVQEEKNYRESLTHCRIRGGMLAMPKDEAANTLIADYVAKSGFFRVFIGVNDLEREGQYMFTDNTPLQNYSNWNEGEPSDPYGHEDCVEMLSSGRWNDTECHLTMYFVCEFIKKKK

SEQ ID NO: 19192 - protein, 268 aa, Homo sapiens
  Payload ID: 3851
  Gene Symbol: COLEC11
  Gene Name: collectin sub-family member 11
  Uniprot ID: Q9BWP8
  ENSP ID: ENSP00000236693
MTPALCRSSSLASKGMRERRETKAPPDGLEESAPREKKQSQPVVTASDISKRKCTSSFVEMGSQGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 19193 - protein, 271 aa, Homo sapiens
  Payload ID: 3851
  Gene Symbol: COLEC11
  Gene Name: collectin sub-family member 11
  Uniprot ID: Q9BWP8
  ENSP ID: ENSP00000339168
MRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 19194 - protein, 247 aa, Homo sapiens
  Payload ID: 3851
  Gene Symbol: COLEC11
  Gene Name: collectin sub-family member 11
  Uniprot ID: Q9BWP8
  ENSP ID: ENSP00000371494
MRGNLALVGVLISLAFLSLLPSGHPQPAGDDACSVQILVPGLKGDAGEKGDKGAPGRPGRVGPTGEKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 19195 - protein, 221 aa, Homo sapiens
  Payload ID: 3851
  Gene Symbol: COLEC11
  Gene Name: collectin sub-family member 11
  Uniprot ID: Q9BWP8
  ENSP ID: ENSP00000384882
MWWVPPSPYGCLPCALPGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 19196 - protein, 245 aa, Homo sapiens
  Payload ID: 3851
  Gene Symbol: COLEC11
  Gene Name: collectin sub-family member 11
  Uniprot ID: Q9BWP8
  ENSP ID: ENSP00000385130
MWWVPPSPYGCLPCALPGDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 19197 - protein, 221 aa, Homo sapiens
  Payload ID: 3851
  Gene Symbol: COLEC11
  Gene Name: collectin sub-family member 11
  Uniprot ID: Q9BWP8
  ENSP ID: ENSP00000385653
MWWVPPSPYGCLPCALPGDAGEKGDKGAPGRPGRVGPTGEKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 19198 - protein, 197 aa, Homo sapiens
  Payload ID: 3851
  Gene Symbol: COLEC11
  Gene Name: collectin sub-family member 11
  Uniprot ID: Q9BWP8
  ENSP ID: ENSP00000385827
MWWVPPSPYGCLPCALPGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 19199 - protein, 123 aa, Homo sapiens
  Payload ID: 3851
  Gene Symbol: COLEC11
  Gene Name: collectin sub-family member 11
  ENSP ID: ENSP00000393167
MKKQRGVGVLPALRMRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEP

SEQ ID NO: 19200 - protein, 116 aa, Homo sapiens
  Payload ID: 3851
  Gene Symbol: COLEC11
  Gene Name: collectin sub-family member 11
  ENSP ID: ENSP00000410919
MRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEPAPSAPQR

SEQ ID NO: 19201 - protein, 285 aa, Homo sapiens
  Payload ID: 3851
  Gene Symbol: COLEC11
  Gene Name: collectin sub-family member 11
  Uniprot ID: Q9BWP8
  ENSP ID: ENSP00000411770
MKKQRGVGVLPALRMRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 19202 - protein, 742 aa, Homo sapiens
  Payload ID: 3852
  Gene Symbol: COLEC12
  Gene Name: collectin sub-family member 12
  Uniprot ID: Q5KU26
  ENSP ID: ENSP00000383115
MKDDFAEEEEVQSFGYKRFGIQEGTQCTKCKNNWALKFSIILLYILCALLTITVAILGYKVVEKMDNVTGGMETSRQTYDDKLTAVESDLKKLGDQTGKKAISTNSELSTFRSDILDLRQQLREITEKTSKNKDTLEKLQASGDALVDRQSQLKETLENNSFLITTVNKTLQAYNGYVTNLQQDTSVLQGNLQNQMYSHNVVIMNLNNLNLTQVQQRNLITNLQRSVDDTSQAIQRIKNDFQNLQQVFLQAKKDTDWLKEKVQSLQTLAANNSALAKANNDTLEDMNSQLNSFTGQMENITTISQANEQNLKDLQDLHKDAENRTAIKFNQLEERFQLFETDIVNIISNISYTAHHLRTLTSNLNEVRTTCTDTLTKHTDDLTSLNNTLANIRLDSVSLRMQQDLMRSRLDTEVANLSVIMEEMKLVDSKHGQLIKNFTILQGPPGPRGPRGDRGSQGPPGPTGNKGQKGEKGEPGPPGPAGERGPIGPAGPPGERGGKGSKGSQGPKGSRGSPGKPGPQGSSGDPGPPGPPGKEGLPGPQGPPGFQGLQGTVGEPGVPGPRGLPGLPGVPGMPGPKGPPGPPGPSGAVVPLALQNEPTPAPEDNGCPPHWKNFTDKCYYFSVEKEIFEDAKLFCEDKSSHLVFINTREEQQWIKKQMVGRESHWIGLTDSERENEWKWLDGTSPDYKNWKAGQPDNWGHGHGPGEDCAGLIYAGQWNDFQCEDVNNFICEKDRETVLSSAL

SEQ ID NO: 19203 - protein, 554 aa, Homo sapiens
  Payload ID: 3853
  Gene Symbol: CSF1
  Gene Name: colony stimulating factor 1 (macrophage)
  Uniprot ID: P09603
  ENSP ID: ENSP00000327513
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSFSPQLQESVFHLLVPSVILVLLAVGGLLFYRWRRRSHQEPQRADSPLEQPEGSPLTQDDRQVELPV

SEQ ID NO: 19204 - protein, 119 aa, Homo sapiens
  Payload ID: 3853
  Gene Symbol: CSF1
  Gene Name: colony stimulating factor 1 (macrophage)
  ENSP ID: ENSP00000349854
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRL

SEQ ID NO: 19205 - protein, 438 aa, Homo sapiens
  Payload ID: 3853
  Gene Symbol: CSF1
  Gene Name: colony stimulating factor 1 (macrophage)
  Uniprot ID: P09603
  ENSP ID: ENSP00000358816
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGHERQSEGSFSPQLQESVFHLLVPSVILVLLAVGGLLFYRWRRRSHQEPQRADSPLEQPEGSPLTQDDRQVELPV

SEQ ID NO: 19206 - protein, 554 aa, Homo sapiens; identical to SEQ ID NO: 19203
  Payload ID: 3853
  Gene Symbol: CSF1
  Gene Name: colony stimulating factor 1 (macrophage)
  Uniprot ID: P09603
  ENSP ID: ENSP00000358817

SEQ ID NO: 19207 - protein, 256 aa, Homo sapiens
  Payload ID: 3853
  Gene Symbol: CSF1
  Gene Name: colony stimulating factor 1 (macrophage)
  Uniprot ID: P09603
  ENSP ID: ENSP00000407317
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQGHERQSEGSFSPQLQESVFHLLVPSVILVLLAVGGLLFYRWRRRSHQEPQRADSPLEQPEGSPLTQDDRQVELPV

SEQ ID NO: 19208 - protein, 113 aa, Homo sapiens
  Payload ID: 3853
  Gene Symbol: CSF1
  Gene Name: colony stimulating factor 1 (macrophage)
  ENSP ID: ENSP00000431547
MIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFN

SEQ ID NO: 19209 - protein, 285 aa, Homo sapiens
  Payload ID: 3853
  Gene Symbol: CSF1
  Gene Name: colony stimulating factor 1 (macrophage)
  ENSP ID: ENSP00000433837
MTAPGAAGRCPPTIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPS

SEQ ID NO: 19210 - protein, 150 aa, Homo sapiens
  Payload ID: 3853
  Gene Symbol: CSF1
  Gene Name: colony stimulating factor 1 (macrophage)
  ENSP ID: ENSP00000434527
MGWGRLQRISLPSQCLSLLSTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPL

SEQ ID NO: 19211 - protein, 972 aa, Homo sapiens
  Payload ID: 3854
  Gene Symbol: CSF1R
  Gene Name: colony stimulating factor 1 receptor
  Uniprot ID: P07333
  ENSP ID: ENSP00000286301
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVAARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRERDYTNLPSSSRSGGSGSSSSELEEESSSEHLTCCEQGDIAQPLLQPNNYQFC

SEQ ID NO: 19212 - protein, 49 aa, Homo sapiens
  Payload ID: 3854
  Gene Symbol: CSF1R
  Gene Name: colony stimulating factor 1 receptor
  ENSP ID: ENSP00000421174
MRHTNYSFSPWHGFTIHRAKFIQSQDYQCSALMGGRKVMSISIRLKVQK

SEQ ID NO: 19213 - protein, 671 aa, Homo sapiens
  Payload ID: 3854
  Gene Symbol: CSF1R
  Gene Name: colony stimulating factor 1 receptor
  ENSP ID: ENSP00000422212
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGTVASPARVWTPMWR

SEQ ID NO: 19214 - protein, 64 aa, Homo sapiens
  Payload ID: 3854
  Gene Symbol: CSF1R
  Gene Name: colony stimulating factor 1 receptor
  ENSP ID: ENSP00000427545
AGSPWALGQRPFGAQGLKGPVCVAATAHADEKEALMSELKIMSHLGQHENIVNLLGACTHGGIS

SEQ ID NO: 19215 - protein, 306 aa, Homo sapiens
  Payload ID: 3854
  Gene Symbol: CSF1R
  Gene Name: colony stimulating factor 1 receptor
  Uniprot ID: P07333
  ENSP ID: ENSP00000445282
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVGTPSPSLCPA

SEQ ID NO: 19216 - protein, 144 aa, Homo sapiens
  Payload ID: 3855
  Gene Symbol: CSF2
  Gene Name: colony stimulating factor 2 (granulocyte-macrophage)
  Uniprot ID: P04141
  ENSP ID: ENSP00000296871
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 19217 - protein, 377 aa, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENSP ID: ENSP00000347606
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFDHLGGIHPRGRERLPRRGLDREGNYLRPRGCRNGMDISASATRGNCFLDDAVNLYIIFYVFI

SEQ ID NO: 19218 - protein, 233 aa, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENSP ID: ENSP00000348058
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIGSLGYSGCSRQFHRSKTN

SEQ ID NO: 19219 - protein, 333 aa, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENSP ID: ENSP00000370911
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSLGYSGCSRQFHRSKTN

SEQ ID NO: 19220 - protein, 410 aa, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENSP ID: ENSP00000370920
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEMGPQRHHRCGWNLYPTPGPSPGSGSSPRLGSESSL

SEQ ID NO: 19221 - protein, 400 aa, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENSP ID: ENSP00000370935
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 19222 - protein, 400 aa, Homo sapiens; identical to SEQ ID NO: 19221
  Payload ID: 3856
  Gene Symbol: CSF2RA
  Gene Name: colony stimulating factor 2 receptor, alpha, low-affinity (granulocyte-macrophage)
  Uniprot ID: P15509
  ENSP ID: ENSP00000370940

SEQ ID NO: 19223 - protein, 434 aa, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENSP ID: ENSP00000394227
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSHSVTQAGVQWHNLGSLQPPSPRLKRFSCLRLPGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 19224 - protein, 188 aa, Homo sapiens
  Payload ID: 3856
  Gene Symbol: CSF2RA
  Gene Name: colony stimulating factor 2 receptor, alpha, low-affinity (granulocyte-macrophage)
  ENSP ID: ENSP00000397452
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTS

SEQ ID NO: 19225 - protein, 238 aa, Homo sapiens
  Payload ID: 3856
  Gene Symbol: CSF2RA
  Gene Name: colony stimulating factor 2 receptor, alpha, low-affinity (granulocyte-macrophage)
  ENSP ID: ENSP00000410667
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWK

SEQ ID NO: 19226 - protein, 400 aa, Homo sapiens; identical to SEQ ID NO: 19221
  Payload ID: 3856
  Gene Symbol: CSF2RA
  Gene Name: colony stimulating factor 2 receptor, alpha, low-affinity (granulocyte-macrophage)
  Uniprot ID: P15509
  ENSP ID: ENSP00000416437

SEQ ID NO: 19227 - protein, 285 aa, Homo sapiens
  Payload ID: 3856
  Gene Symbol: CSF2RA
  Gene Name: colony stimulating factor 2 receptor, alpha, low-affinity (granulocyte-macrophage)
  ENSP ID: ENSP00000436825
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLVLTTGTSALCTFMCS

SEQ ID NO: 19228 - protein, 267 aa, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENSP ID: ENSP00000440491
MNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 19229 - protein, 90 aa, Homo sapiens
  Payload ID: 3856
  Gene Symbol: CSF2RA
  Gene Name: colony stimulating factor 2 receptor, alpha, low-affinity (granulocyte-macrophage)
  ENSP ID: ENSP00000476684
MLLLVTSLLLCELPHPAFLLIPEKSDLRTVAPASSLNVRFDSRTMNLSWDCQENTTFSKCFLTDKKNRVVEPRMEFPSCCPDRTIAHQPA

SEQ ID NO: 19230 - protein, 889 aa, Homo sapiens
  Payload ID: 3857
  Gene Symbol: CSF2RB
  Gene Name: colony stimulating factor 2 receptor, beta, low-affinity (granulocyte-macrophage)
  ENSP ID: ENSP00000262825
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALVVSVMSVGPPVP

SEQ ID NO: 19231 - protein, 897 aa, Homo sapiens
  Payload ID: 3857
  Gene Symbol: CSF2RB
  Gene Name: colony stimulating factor 2 receptor, beta, low-affinity (granulocyte-macrophage)
  Uniprot ID: P32927
  ENSP ID: ENSP00000384053
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 19232 - protein, 903 aa, Homo sapiens
  Payload ID: 3857
  Gene Symbol: CSF2RB
  Gene Name: colony stimulating factor 2 receptor, beta, low-affinity (granulocyte-macrophage)
  Uniprot ID: P32927
  ENSP ID: ENSP00000385271
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGSAVLLREEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 19233 - protein, 228 aa, Homo sapiens
  Payload ID: 3857
  Gene Symbol: CSF2RB
  Gene Name: colony stimulating factor 2 receptor, beta, low-affinity (granulocyte-macrophage)
  ENSP ID: ENSP00000393585
MPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQI

SEQ ID NO: 19234 - protein, 207 aa, Homo sapiens
  Payload ID: 3858
  Gene Symbol: CSF3
  Gene Name: colony stimulating factor 3 (granulocyte)
  Uniprot ID: P09919
  ENSP ID: ENSP00000225474
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 19235 - protein, 200 aa, Homo sapiens
  Payload ID: 3858
  Gene Symbol: CSF3
  Gene Name: colony stimulating factor 3 (granulocyte)
  ENSP ID: ENSP00000327766
MSPEPALSPALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 19236 - protein, 171 aa, Homo sapiens
  Payload ID: 3858
  Gene Symbol: CSF3
  Gene Name: colony stimulating factor 3 (granulocyte)
  Uniprot ID: P09919
  ENSP ID: ENSP00000377704
MAGPATQSPMKLMALQLLLWHSALWTVQEATPLGPASSLPQSFLLKCLEQVRKIQGDGAALQEKLVSEAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 19237 - protein, 204 aa, Homo sapiens
  Payload ID: 3858
  Gene Symbol: CSF3
  Gene Name: colony stimulating factor 3 (granulocyte)
  Uniprot ID: P09919
  ENSP ID: ENSP00000377705
MAGPATQSPMKLMALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 19238 - protein, 164 aa, Homo sapiens
  Payload ID: 3858
  Gene Symbol: CSF3
  Gene Name: colony stimulating factor 3 (granulocyte)
  ENSP ID: ENSP00000462991
MSPEPALSPALQLLLWHSALWTVQEATPLGPASSLPQSFLLKCLEQVRKIQGDGAALQEKLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 19239 - protein, 57 aa, Homo sapiens
  Payload ID: 3858
  Gene Symbol: CSF3
  Gene Name: colony stimulating factor 3 (granulocyte)
  ENSP ID: ENSP00000464157
MAGPATQSPMKLMVCHLQAVPPRGAGAARTLSGHPLGSPEQLPQPGPAAGRLLEPTP

SEQ ID NO: 19240 - protein, 155 aa, Homo sapiens
  Payload ID: 3858
  Gene Symbol: CSF3
  Gene Name: colony stimulating factor 3 (granulocyte)
  ENSP ID: ENSP00000464421
MAGPATQSPMKLMALQLLLWHSALWTVQEATPLGPASSLPQSFLLKCLEQVRKIQGDGAALQEKLAGCLSQLHSGLFLYQGLLQALEGISPELGPTLDTLQLDVADFATTIWQQMEELGMAPALQPTQGAMPAFASAFQRRAGGVLVASHLQSFL

SEQ ID NO: 19241 - protein, 783 aa, Homo sapiens
  Payload ID: 3859
  Gene Symbol: CSF3R
  Gene Name: colony stimulating factor 3 receptor (granulocyte)
  Uniprot ID: Q99062
  ENSP ID: ENSP00000332180
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQAGPPRRSAYFKDQIMLHPAPPNGLLCLFPITSVL

SEQ ID NO: 19242 - protein, 836 aa, Homo sapiens
  Payload ID: 3859
  Gene Symbol: CSF3R
  Gene Name: colony stimulating factor 3 receptor (granulocyte)
  Uniprot ID: Q99062
  ENSP ID: ENSP00000355406
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 19243 - protein, 863 aa, Homo sapiens
  Payload ID: 3859
  Gene Symbol: CSF3R
  Gene Name: colony stimulating factor 3 receptor (granulocyte)
  Uniprot ID: Q99062
  ENSP ID: ENSP00000362195
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEELPGPRQGQWLGQTSEMSRALTPHPCVQDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 19244 - protein, 783 aa, Homo sapiens; identical to SEQ ID NO: 19241
  Payload ID: 3859
  Gene Symbol: CSF3R
  Gene Name: colony stimulating factor 3 receptor (granulocyte)
  Uniprot ID: Q99062
  ENSP ID: ENSP00000362196

SEQ ID NO: 19245 - protein, 836 aa, Homo sapiens; identical to SEQ ID NO: 19242
  Payload ID: 3859
  Gene Symbol: CSF3R
  Gene Name: colony stimulating factor 3 receptor (granulocyte)
  Uniprot ID: Q99062
  ENSP ID: ENSP00000362198

SEQ ID NO: 19246 - protein, 21 aa, Homo sapiens
  Payload ID: 3859
  Gene Symbol: CSF3R
  Gene Name: colony stimulating factor 3 receptor (granulocyte)
  ENSP ID: ENSP00000431639
MARLGNCSLTWAALIILLLPG

SEQ ID NO: 19247 - protein, 388 aa, Homo sapiens
  Payload ID: 3859
  Gene Symbol: CSF3R
  Gene Name: colony stimulating factor 3 receptor (granulocyte)
  ENSP ID: ENSP00000435218
  MOD_RES (1)..(1): Any amino acid
XTSRPTPVVFSESRGPALTRLHAMARDPHSLWVGWEPPNPWPQGYVIEWGLGPPSASNSNKTWRMEQNGRATGFLLKAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 19248 - protein, 154 aa, Homo sapiens
  Payload ID: 3860
  Gene Symbol: COLCA2
  Gene Name: colorectal cancer associated 2
  Uniprot ID: A8K830
  ENSP ID: ENSP00000381115
MHPEPLLNSTQSAPHHFPDSFQATPFCFNQSLIPGSPSNSSILSGSLDYSYSPVQLPSYAPENYNSPASLDTRTCGYPPEDHSYQHLSSHAQYSCFSSATTSICYCASCEAEDLDALQAAEYFYPSTDCVDFAPSAAATSDFYKRETNCDICYS

SEQ ID NO: 19249 - protein, 154 aa, Homo sapiens; identical to SEQ ID NO: 19248
  Payload ID: 3860
  Gene Symbol: COLCA2
  Gene Name: colorectal cancer associated 2
  Uniprot ID: A8K830
  ENSP ID: ENSP00000434519

SEQ ID NO: 19250 - protein, 106 aa, Homo sapiens
  Payload ID: 3860
  Gene Symbol: COLCA2
  Gene Name: colorectal cancer associated 2
  ENSP ID: ENSP00000434938
MHPEPLLNSTQSAPHHFPDSFQATPFCFNQSLIPGSPSNSSILSGSLDYSYSPVQLPSYAPENYNSPASLDTRTCGYPPEDHSYQHLSSHAQYSCFSSATTSICYC

SEQ ID NO: 19251 - protein, 154 aa, Homo sapiens; identical to SEQ ID NO: 19248
  Payload ID: 3860
  Gene Symbol: COLCA2
  Gene Name: colorectal cancer associated 2
  Uniprot ID: A8K830
  ENSP ID: ENSP00000481028

SEQ ID NO: 19252 - protein, 251 aa, Homo sapiens
  Payload ID: 3860
  Gene Symbol: COLCA2
  Gene Name: colorectal cancer associated 2
  Uniprot ID: A8K830
  ENSP ID: ENSP00000484135
MSEKPKVYQGVRVKITVKELLQQRRAHQAASGGTRSGGSSVHLSDPVAPSSAGLYFEPEPISSTPNYLQRGEFSSCVSCEENSSCLDQIFDSYLQTEMHPEPLLNSTQSAPHHFPDSFQATPFCFNQSLIPGSPSNSSILSGSLDYSYSPVQLPSYAPENYNSPASLDTRTCGYPPEDHSYQHLSSHAQYSCFSSATTSICYCASCEAEDLDALQAAEYFYPSTDCVDFAPSAAATSDFYKRETNCDICYS

SEQ ID NO: 19253 - protein, 202 aa, Homo sapiens
  Payload ID: 3861
  Gene Symbol: COMMD10
  Gene Name: COMM domain containing 10
  Uniprot ID: Q9Y6G5
  ENSP ID: ENSP00000274458
MAVPAALILRESPSMKKAVSLINAIDTGRFPRLLTRILQKLHLKAESSFSEEEEEKLQAAFSLEKQDLHLVLETISFILEQAVYHNVKPAALQQQLENIHLRQDKAEAFVNTWSSMGQETVEKFRQRILAPCKLETVGWQLNLQMAHSAQAKLKSPQAVLQLGVNNEDSKSLEKVLVEFSHKELFDFYNKLETIQAQLDSLT

SEQ ID NO: 19254 - protein, 139 aa, Homo sapiens
  Payload ID: 3861
  Gene Symbol: COMMD10
  Gene Name: COMM domain containing 10
  ENSP ID: ENSP00000422448
MAVPAALILRESPSMKKAVSLINAIDTGRFPRLLTRILQKLHLKAESSFSEEEEEKLQAAFSLEKQDLHLVLETISFILEQAVYHNVKPAALQQQLENIHLRQDKAEAFVNTWSSMGQETVEKFRQRILAPSRDRWMAA

SEQ ID NO: 19255 - protein, 121 aa, Homo sapiens
  Payload ID: 3861
  Gene Symbol: COMMD10
  Gene Name: COMM domain containing 10
  ENSP ID: ENSP00000424611
AESSFSEEEEEKLQAAFSLEKQDLHLVLETISFILEQAVYHNVKPAALQQQLENIHLRQDKAEAFVNTWSSMGQETVEKFRQRILAPCKSLEKVLVEFSHKELFDFYNKLETIQAQLDSLT

SEQ ID NO: 19256 - protein, 188 aa, Homo sapiens
  Payload ID: 3861
  Gene Symbol: COMMD10
  Gene Name: COMM domain containing 10
  ENSP ID: ENSP00000427319
MKKAVSLINAIDTGRFPRLLTRILQKLHLKAESSFSEEEEEKLQAAFSLEKQDLHLVLETISFILEQAVYHNVKPAALQQQLENIHLRQDKAEAFVNTWSSMGQETVEKFRQRILAPCKLETVGWQLNLQMAHSAQAKLKSPQAVLQLGVNNEDSKSLEKVLVEFSHKELFDFYNKLETIQAQLDSLT

SEQ ID NO: 19257 - protein, 188 aa, Homo sapiens; identical to SEQ ID NO: 19256
  Payload ID: 3861
  Gene Symbol: COMMD10
  Gene Name: COMM domain containing 10
  ENSP ID: ENSP00000488332

SEQ ID NO: 19258 - protein, 135 aa, Homo sapiens
  Payload ID: 3862
  Gene Symbol: COMMD2
  Gene Name: COMM domain containing 2
  ENSP ID: ENSP00000417962
MLLELSEEHKEHLAFLPQVDSAVVAEFGRIAVEFLRRGANPKIYEGAARKLNVSSDTVQHGVEGLTYLLTESSKLMISELDFQDSVFVLGFSEELNKLLLQLYLDNRKEIRTILSELAPSLPSYHNLEWRLDVQM

SEQ ID NO: 19259 - protein, 121 aa, Homo sapiens
  Payload ID: 3862
  Gene Symbol: COMMD2
  Gene Name: COMM domain containing 2
  ENSP ID: ENSP00000418865
MLLELSEEHKEHLAFLPQVDSAVVAEFGRIAVEFLRRGANPKIYEGAARKLNVSSDTVQHGVEGLTYLLTESSKLMVRDFLDCFVLAGFLRTVWCTLHHSPGRFLNWISKTLFLFWDSLKN

SEQ ID NO: 19260 - protein, 199 aa, Homo sapiens
  Payload ID: 3862
  Gene Symbol: COMMD2
  Gene Name: COMM domain containing 2
  Uniprot ID: Q86X83
  ENSP ID: ENSP00000419475
MLLELSEEHKEHLAFLPQVDSAVVAEFGRIAVEFLRRGANPKIYEGAARKLNVSSDTVQHGVEGLTYLLTESSKLMISELDFQDSVFVLGFSEELNKLLLQLYLDNRKEIRTILSELAPSLPSYHNLEWRLDVQLASRSLRQQIKPAVTIKLHLNQNGDHNTKVLQTDPATLLHLVQQLEQALEEMKTNHCRRVVRNIK

SEQ ID NO: 19261 - protein, 195 aa, Homo sapiens
  Payload ID: 3863
  Gene Symbol: COMMD3
  Gene Name: COMM domain containing 3
  Uniprot ID: Q9UBI1
  ENSP ID: ENSP00000366032
MELSESVQKGFQMLADPRSFDSNAFTLLLRAAFQSLLDAQADEAVLDHPDLKHIDPVVLKHCHAAAATYILEAGKHRADKSTLSTYLEDCKFDRERIELFCTEYQNNKNSLEILLGSIGRSLPHITDVSWRLEYQIKTNQLHRMYRPAYLVTLSVQNTDSPSYPEISFSCSMEQLQDLVGKLKDASKSLERATQL

SEQ ID NO: 19262 - protein, 149 aa, Homo sapiens
  Payload ID: 3863
  Gene Symbol: COMMD3
  Gene Name: COMM domain containing 3
  ENSP ID: ENSP00000391237
  MOD_RES (1)..(1): Any amino acid
XLPDAGGSPLLRLQRLHASPPGGIPESAGRPGGRGRVSTYLEDCKFDRERIELFCTEYQNNKNSLEILLGSIGRSLPHITDVSWRLEYQIKTNQLHRMYRPAYLVTLSVQNTDSPSYPEISFSCSMEQLQDLVGKLKDASKSLERATQL

SEQ ID NO: 19263 - protein, 163 aa, Homo sapiens
  Payload ID: 3863
  Gene Symbol: COMMD3
  Gene Name: COMM domain containing 3
  ENSP ID: ENSP00000394580
  MOD_RES (1)..(1): Any amino acid
XMELSESVQKGFQMLADPRSFDSNAFTLLLRAAFQSLLDAQADEAVLDHPDLKHIDPVVLKHCHAAAATYILEAGKHRADKSTLSIGRSLPHITDVSWRLEYQIKTNQLHRMYRPAYLVTLSVQNTDSPSYPEISFSCSMEQLQDLVGKLKDASKSLERATQL

SEQ ID NO: 19264 - protein, 177 aa, Homo sapiens
  Payload ID: 3863
  Gene Symbol: COMMD3
  Gene Name: COMM domain containing 3
  ENSP ID: ENSP00000408982
  MOD_RES (1)..(1): Any amino acid
XELSESVQKGFQMLADPRSFDSNAFTLLLRAAFQSLLDAQADEAVLDHPDLKHIDPVVLKHCHAAAATYILEAGKHRADKSTLSTYLEDCKFDRERIELFCTEYQNNKNSLEILLGRTLIPHPIQRLVLVAAWNNYRTWWGNLKMLRKAWKEQLSCNLGKLTIRPSAEENQKRLAFS

SEQ ID NO: 19265 - protein, 48 aa, Homo sapiens
  Payload ID: 3863
  Gene Symbol: COMMD3
  Gene Name: COMM domain containing 3
  ENSP ID: ENSP00000473433
  MOD_RES (1)..(1): Any amino acid
XESVQKGFQMLADPRSFDSNAFTLLLRAAFQSLLDAQADEAVLGITGS

SEQ ID NO: 19266 - protein, 74 aa, Homo sapiens
  Payload ID: 3863
  Gene Symbol: COMMD3
  Gene Name: COMM domain containing 3
  ENSP ID: ENSP00000473624
NNKNSLEILLGSIGRSLPHITDVSWRLEYQIKTNQLHRMYRPAYLVTLSVQNTDSPSYPEISFSCSMEQLQVQY

SEQ ID NO: 19267 - protein, 199 aa, Homo sapiens
  Payload ID: 3864
  Gene Symbol: COMMD4
  Gene Name: COMM domain containing 4
  Uniprot ID: Q9H0A8
  ENSP ID: ENSP00000267935
MRFRFCGDLDCPDWVLAEISTLAKMSSVKLRLLCSQVLKELLGQGIDYEKILKLTADAKFESGDVKATVAVLSFILSSAAKHSVDGESLSSELQQLGLPKEHAASLCRCYEEKQSPLQKHLRVCSLRMNRLAGVGWRVDYTLSSSLLQSVEEPMVHLRLEVAAAPGTPAQPVAMSLSADKFQVLLAELKQAQTLMSSLG

SEQ ID NO: 19268 - protein, 140 aa, Homo sapiens
  Payload ID: 3864
  Gene Symbol: COMMD4
  Gene Name: COMM domain containing 4
  Uniprot ID: Q9H0A8
  ENSP ID: ENSP00000340867
MRFRFCGDLDCPDWVLAEISTLAKMSSVKLRLLCSQVLKELLGQGIDYEKILKLTADAKFESGDVKATVAVLSFILSSAAKHSVDGESLSSELQQLGLPKEHAASLCRCYEEKQSPLQKHLRVCSLRKLKQAQTLMSSLG

SEQ ID NO: 19269 - protein, 199 aa, Homo sapiens; identical to SEQ ID NO: 19267
  Payload ID: 3864
  Gene Symbol: COMMD4
  Gene Name: COMM domain containing 4
  Uniprot ID: Q9H0A8
  ENSP ID: ENSP00000433662

SEQ ID NO: 19270 - protein, 211 aa, Homo sapiens
  Payload ID: 3864
  Gene Symbol: COMMD4
  Gene Name: COMM domain containing 4
  ENSP ID: ENSP00000454283
MRGRQVAPETGGGCTGLSANTVCAGVRARFRFCGDLDCPDWVLAEISTLAKMSSVKLRLLCSQVLKELLGQGIDYEKILKLTADAKFESGDVKATVAVLSFILSSAAKHSVDGESLSSELQQLGLPKEHAASLCRCYEEKQSPLQKHLRVCSLRMNRLAGVGWRVDYTLSSSLLQSVEEPMVHLRLEVAAAPGTPAQPVAMSLSADKFQVL

SEQ ID NO: 19271 - protein, 177 aa, Homo sapiens
  Payload ID: 3864
  Gene Symbol: COMMD4
  Gene Name: COMM domain containing 4
  ENSP ID: ENSP00000455249
MRFRFCGDLDCPDWVLAEISTLAKMYEKILKLTADAKFESGDVKATVAVLSFILSSAAKHSVDGESLSSELQQLGLPKEHAASLCRCYEEKQSPLQKHLRVCSLRMNRLAGVGWRVDYTLSSSLLQSVEEPMVHLRLEVAAAPGTPAQPVAMSLSADKFQVLLAELKQAQTLMSSLG

SEQ ID NO: 19272 - protein, 136 aa, Homo sapiens
  Payload ID: 3864
  Gene Symbol: COMMD4
  Gene Name: COMM domain containing 4
  ENSP ID: ENSP00000455303
MRGRQVAPETGGGCTGLSANTVCAGVRAVSLYEKILKLTADAKFESGDVKATVAVLSFILSSAAKHSVDGESLSSELQQLGLPKEHAASLCRCYEEKQSPLQKHLRVCSLRMNRLAGVGWRVDYTLSSSLLQSVEE

SEQ ID NO: 19273 - protein, 146 aa, Homo sapiens
  Payload ID: 3864
  Gene Symbol: COMMD4
  Gene Name: COMM domain containing 4
  ENSP ID: ENSP00000455750
MRGRQVAPETGGGCTGLSANTVCAGVRAVSLSSVKLRLLCSQVLKELLGQGIDYEKILKLTADAKFESGDVKATVAVLSFILSSAAKHSVDGESLSSELQQLGLPKEHAASLCRCYEEKQSPLQKHLRVCSLRKLKQAQTLMSSLG

SEQ ID NO: 19274 - protein, 110 aa, Homo sapiens
  Payload ID: 3864
  Gene Symbol: COMMD4
  Gene Name: COMM domain containing 4
  ENSP ID: ENSP00000456440
MRFRFCGDLDCPDWVLAEISTLAKMSSVKLRLLCSQVLKELLGQGIDYEKILKLTADAKFVRPSTVSMANPCPVNCSSWGCPKSTRPACAAVMRRSKAPCRSTCGSAAYA

SEQ ID NO: 19275 - protein, 52 aa, Homo sapiens
  Payload ID: 3864
  Gene Symbol: COMMD4
  Gene Name: COMM domain containing 4
  ENSP ID: ENSP00000457348
MRFRFCGDLDCPDWVLAEISTLAKMSSVKLRLLCSQVLKELLGQGIDDPGWG

SEQ ID NO: 19276 - protein, 113 aa, Homo sapiens
  Payload ID: 3864
  Gene Symbol: COMMD4
  Gene Name: COMM domain containing 4
  Uniprot ID: Q9H0A8
  ENSP ID: ENSP00000457693
MRFRFCGDLDCPDWVLAEISTLAKMSSVKLRLLCSQVLKELLGQGIDYEKILKLTADAKFESGDVKATVAVLSFILSSAAKHSVDGESLSSELQQLGLPKELKQAQTLMSSLG

SEQ ID NO: 19277 - protein, 224 aa, Homo sapiens
  Payload ID: 3865
  Gene Symbol: COMMD5
  Gene Name: COMM domain containing 5
  Uniprot ID: Q9GZQ3
  ENSP ID: ENSP00000304544
MSAVGAATPYLHHPGDSHSGRVSFLGAQLPPEVAAMARLLGDLDRSTFRKLLKFVVSSLQGEDCREAVQRLGVSANLPEEQLGALLAGMHTLLQQALRLPPTSLKPDTFRDQLQELCIPQDLVGDLASVVFGSQRPLLDSVAQQQGAWLPHVADFRWRVDVAISTSALARSLQPSVLMQLKLSDGSAYRFEVPTAKFQELRYSVALVLKEMADLEKRCERRLQD

SEQ ID NO: 19278 - protein, 224 aa, Homo sapiens; identical to SEQ ID NO: 19277
  Payload ID: 3865
  Gene Symbol: COMMD5
  Gene Name: COMM domain containing 5
  Uniprot ID: Q9GZQ3
  ENSP ID: ENSP00000385793

SEQ ID NO: 19279 - protein, 224 aa, Homo sapiens; identical to SEQ ID NO: 19277
  Payload ID: 3865
  Gene Symbol: COMMD5
  Gene Name: COMM domain containing 5
  Uniprot ID: Q9GZQ3
  ENSP ID: ENSP00000394331

SEQ ID NO: 19280 - protein, 171 aa, Homo sapiens
  Payload ID: 3865
  Gene Symbol: COMMD5
  Gene Name: COMM domain containing 5
  ENSP ID: ENSP00000433758
MSAVGAATPYLHHPGDSHSGRVSFLGAQLPPEVAAMARLLGDLDRSTFRKLLKFVVSSLQGEDCREAVQRLGVSANLPEEQLGALLAGMHTLLQQALRLPPTSLKPDTFRDQLQELCIPQDLVGDLASVVFGSQRPLLDSVAQQQGAWLPHVADFRWRVDVAISTSALARS

SEQ ID NO: 19281 - protein, 171 aa, Homo sapiens; identical to SEQ ID NO: 19280
  Payload ID: 3865
  Gene Symbol: COMMD5
  Gene Name: COMM domain containing 5
  ENSP ID: ENSP00000435552

SEQ ID NO: 19282 - protein, 170 aa, Homo sapiens
  Payload ID: 3865
  Gene Symbol: COMMD5
  Gene Name: COMM domain containing 5
  ENSP ID: ENSP00000436382
  MOD_RES (1)..(1): Any amino acid
XVSSLQGEDCREAVQRLGVSANLPEEQLGALLAGMHTLLQQALRLPPTSLKPDTFRDQLQELCIPQDLVGDLASVVFGSQRPLLDSVAQQQGAWLPHVADFRWRVDVAISTSALARSLQPSVLMQLKLSDGSAYRFEVPTAKFQELRYSVALVLKEMADLEKRCERRLQD

SEQ ID NO: 19283 - protein, 224 aa, Homo sapiens; identical to SEQ ID NO: 19277
  Payload ID: 3865
  Gene Symbol: COMMD5
  Gene Name: COMM domain containing 5
  Uniprot ID: Q9GZQ3
  ENSP ID: ENSP00000445840

SEQ ID NO: 19284 - protein, 98 aa, Homo sapiens
  Payload ID: 3866
  Gene Symbol: COMMD6
  Gene Name: COMM domain containing 6
  Uniprot ID: Q7Z4G1
  ENSP ID: ENSP00000348054
MEASSEPPLDAKSDVTNQLVDFQWKLGMAVSSDTCRSLKYPYVAVMLKVADHSGQVKTKCFEMTIPQFQPQLLATSSLLSASNFYRQFKEIAAVIETV

SEQ ID NO: 19285 - protein, 39 aa, Homo sapiens
  Payload ID: 3866
  Gene Symbol: COMMD6
  Gene Name: COMM domain containing 6
  ENSP ID: ENSP00000366838
MEASSEPPLDAKSDVSSNLEGEFSVETGYGCELRHLQIS

SEQ ID NO: 19286 - protein, 85 aa, Homo sapiens
  Payload ID: 3866
  Gene Symbol: COMMD6
  Gene Name: COMM domain containing 6
  Uniprot ID: Q7Z4G1
  ENSP ID: ENSP00000366841
MEASSEPPLDAKSDVTNQLVDFQWKLGMAVSSDTCRSLKYPYVAVMLKVADHSGQVKTKCFEMTIPQFQNFYRQFKEIAAVIETV

SEQ ID NO: 19287 - protein, 100 aa, Homo sapiens
  Payload ID: 3866
  Gene Symbol: COMMD6
  Gene Name: COMM domain containing 6
  ENSP ID: ENSP00000366845
MKAPLPHPALARRMQIKDCWALIRRQLFEARNTLVDFQWKLGMAVSSDTCRSLKYPYVAVMLKVADHSGQVKTKCFEMTIPQFQNFYRQFKEIAAVIETV

SEQ ID NO: 19288 - protein, 85 aa, Homo sapiens; identical to SEQ ID NO: 19286
  Payload ID: 3866
  Gene Symbol: COMMD6
  Gene Name: COMM domain containing 6
  Uniprot ID: Q7Z4G1
  ENSP ID: ENSP00000385660

SEQ ID NO: 19289 - protein, 39 aa, Homo sapiens; identical to SEQ ID NO: 19285
  Payload ID: 3866
  Gene Symbol: COMMD6
  Gene Name: COMM domain containing 6
  ENSP ID: ENSP00000485825

SEQ ID NO: 19290 - protein, 200 aa, Homo sapiens
  Payload ID: 3867
  Gene Symbol: COMMD7
  Gene Name: COMM domain containing 7
  Uniprot ID: Q86VX2
  ENSP ID: ENSP00000278980
MGRLHCTEDPVPEAVGGDMQQLNQLGAQQFSALTEVLFHFLTEPKEVERFLAQLSEFATTNQISLGSLRSIVKSLLLVPNGALKKSLTAKQVQADFITLGLSEEKATYFSEKWKQNAPTLARWAIGQTLMINQLIDMEWKFGVTSGSSELEKVGSIFLQLKLVVKKGNQTENVYIELTLPQFYSFLHEMERVRTSMECFC

SEQ ID NO: 19291 - protein, 199 aa, Homo sapiens
  Payload ID: 3867
  Gene Symbol: COMMD7
  Gene Name: COMM domain containing 7
  Uniprot ID: Q86VX2
  ENSP ID: ENSP00000395339
MGRLHCTEDPVPEAVGGDMQQLNQLGAQFSALTEVLFHFLTEPKEVERFLAQLSEFATTNQISLGSLRSIVKSLLLVPNGALKKSLTAKQVQADFITLGLSEEKATYFSEKWKQNAPTLARWAIGQTLMINQLIDMEWKFGVTSGSSELEKVGSIFLQLKLVVKKGNQTENVYIELTLPQFYSFLHEMERVRTSMECFC

SEQ ID NO: 19292 - protein, 157 aa, Homo sapiens
  Payload ID: 3867
  Gene Symbol: COMMD7
  Gene Name: COMM domain containing 7
  ENSP ID: ENSP00000476443
MGRLHCTEDPVPEAVGGDMQQLNQLGAQQFSALTEVLFHFLTEPKEARVFTVLSLQVERFLAQLSEFATTNQISLGSLRSIVKSLLLVPNGALKKSLTAKQVQADFITLGLSEEKATYFSEKWKQNAPTLARWAIGQTLMINQLIDMEWKFGVTSGS

SEQ ID NO: 19293 - protein, 57 aa, Homo sapiens
  Payload ID: 3867
  Gene Symbol: COMMD7
  Gene Name: COMM domain containing 7
  ENSP ID: ENSP00000476617
MGRLHCTEDPVPEAVGGDMQQLNQLGAQAAGANQGSLGGILLLCWLGCLFIPPRLLK

SEQ ID NO: 19294 - protein, 183 aa, Homo sapiens
  Payload ID: 3868
  Gene Symbol: COMMD8
  Gene Name: COMM domain containing 8
  Uniprot ID: Q9NX08
  ENSP ID: ENSP00000370984
MEPEEGTPLWRLQKLPAELGPQLLHKIIDGICGRAYPVYQDYHTVWESEEWMHVLEDIAKFFKAIVGKNLPDEEIFQQLNQLNSLHQETIMKCVKSRKDEIKQALSREIVAISSAQLQDFDWQVKLALSSDKIAALRMPLLSLHLDVKENGEVKPYSIEMSREELQNLIQSLEAANKVVLQLK

SEQ ID NO: 19295 - protein, 198 aa, Homo sapiens
  Payload ID: 3869
  Gene Symbol: COMMD9
  Gene Name: COMM domain containing 9
  Uniprot ID: Q9P000
  ENSP ID: ENSP00000263401
MAALTAEHFAALQSLLKASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQISLPRLVDLDWRVDIKTSSDSISRMAVPTCLLQMKIQEDPSLCGDKPSISAVTVELSKETLDTMLDGLGRIRDQLSAVASK

SEQ ID NO: 19296 - protein, 156 aa, Homo sapiens
  Payload ID: 3869
  Gene Symbol: COMMD9
  Gene Name: COMM domain containing 9
  Uniprot ID: Q9P000
  ENSP ID: ENSP00000392510
MAALTAEHFAALQSLLKLLQALHRLTRLVAFRDLSSAEAILALFPENFHQNLKNLLTKIILEHVSTWRTEAQANQISLPRLVDLDWRVDIKTSSDSISRMAVPTCLLQMKIQEDPSLCGDKPSISAVTVELSKETLDTMLDGLGRIRDQLSAVASK

SEQ ID NO: 19297 - protein, 185 aa, Homo sapiens
  Payload ID: 3869
  Gene Symbol: COMMD9
  Gene Name: COMM domain containing 9
  ENSP ID: ENSP00000435599
MAALTAEHFAALQSLLKASSKDVVRQLCQESFSSSALGLKKLLDVTCSSLSVTQEEAEELLQALHRLTRLVAFRDLSSAEAILALFPENFHQNLKNLLTKIILEHVLSATPGRSGLESGYQNLLRQHQPHGRPHLPAPDEDPRRSQPMRRQTLHLSCHRGAEQRNTGHHVRWPGPHPRPTLCRGQ

SEQ ID NO: 19298 - protein, 53 aa, Homo sapiens
  Payload ID: 3870
  Gene Symbol: COMMD3-BMI1
  Gene Name: COMMD3-BMI1 readthrough
  ENSP ID: ENSP00000398759
  MOD_RES (1)..(1): Any amino acid
XMLADPRSFDSNAFTLLLRAAFQSLLDAQADEAVLGFFIKQKCIEQRESRSLS

SEQ ID NO: 19299 - protein, 159 aa, Homo sapiens
  Payload ID: 3870
  Gene Symbol: COMMD3-BMI1
  Gene Name: COMMD3-BMI1 readthrough
  ENSP ID: ENSP00000473382
MELSESVQKGFQMLADPRSFDSNAFTLLLRAAFQSLLDAQADEAVLDHPDLKHIDPVVLKHCHAAAATYILEAGKHRADKSTLSTYLEDCKFDRERIELFCTEYQNNKNSLEILLGRIFYQAEMHRTTRIKITELNPHLMCVLCGGYFIDATTIIECLH

SEQ ID NO: 19300 - protein, 469 aa, Homo sapiens
  Payload ID: 3870
  Gene Symbol: COMMD3-BMI1
  Gene Name: COMMD3-BMI1 readthrough
  ENSP ID: ENSP00000473391
MELSESVQKGFQMLADPRSFDSNAFTLLLRAAFQSLLDAQADEAVLDHPDLKHIDPVVLKHCHAAAATYILEAGKHRADKSTLSTYLEDCKFDRERIELFCTEYQNNKNSLEILLGRTLIPHPIQRLVLVAAWNNYRIFYQAEMHRTTRIKITELNPHLMCVLCGGYFIDATTIIECLHSFCKTCIVRYLETSKYCPICDVQVHKTRPLLNIRSDKTLQDIVYKLVPGLFKNEMKRRRDFYAAHPSADAANGSNEDRGEVADEDKRIITDDEIISLSIEFFDQNRLDRKVNKDKEKSKEEVNDKRYLRCPAAMTVMHLRKFLRSKMDIPNTFQIDVMYEEEPLKDYYTLMDIAYIYTWRRNGPLPLKYRVRPTCKRMKISHQRDGLTNAGELESDSGSDKANSPAGGIPSTSSCLPSPSTPVQSPHPQFPHISSTMNGTSNSPSGNHQSSFANRPRKSSVNGSSATSSG

SEQ ID NO: 19301 - protein, 110 aa, Homo sapiens
  Payload ID: 3870
  Gene Symbol: COMMD3-BMI1
  Gene Name: COMMD3-BMI1 readthrough
  ENSP ID: ENSP00000473495
  MOD_RES (1)..(1): Any amino acid
XSVQKGFQMLADPRSFDSNAFTLLLRAAFQSLLDAQADEAVLDHPDLKHIDPVVLKHCHAAAATYILEAGKHRADKSTLRIFYQAEMHRTTRIKITELNPHLMCVLCGGY

SEQ ID NO: 19302 - protein, 2489 aa, Homo sapiens
  Payload ID: 3871
  Gene Symbol: CR1
  Gene Name: complement component (3b/4b) receptor 1 (Knops blood group)
  ENSP ID: ENSP00000356016
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFTLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRVLP

SEQ ID NO: 19303 - protein, 2039 aa, Homo sapiens
  Payload ID: 3871
  Gene Symbol: CR1
  Gene Name: complement component (3b/4b) receptor 1 (Knops blood group)
  Uniprot ID: P17927
  ENSP ID: ENSP00000356018
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFTLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRVLP

SEQ ID NO: 19304 - protein, 2039 aa, Homo sapiens
  Payload ID: 3871
  Gene Symbol: CR1
  Gene Name: complement component (3b/4b) receptor 1 (Knops blood group)
  ENSP ID: ENSP00000356019
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFTLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRVLP

SEQ ID NO: 19305 - protein, 2039 aa, Homo sapiens
  Payload ID: 3871
  Gene Symbol: CR1
  Gene Name: complement component (3b/4b) receptor 1 (Knops blood group)
  Uniprot ID: P17927
  ENSP ID: ENSP00000356020
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFTLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRVLP

SEQ ID NO: 19306 - protein, 2039 aa, Homo sapiens; identical to SEQ ID NO: 19305
  Payload ID: 3871
  Gene Symbol: CR1
  Gene Name: complement component (3b/4b) receptor 1 (Knops blood group)
  Uniprot ID: P17927
  ENSP ID: ENSP00000383744

SEQ ID NO: 19307 - protein, 660 aa, Homo sapiens
  Payload ID: 3871
  Gene Symbol: CR1
  Gene Name: complement component (3b/4b) receptor 1 (Knops blood group)
  ENSP ID: ENSP00000434718
  MOD_RES (1)..(1): Any amino acid
XSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRY

SEQ ID NO: 19308 - protein, 604 aa, Homo sapiens
  Payload ID: 3871
  Gene Symbol: CR1
  Gene Name: complement component (3b/4b) receptor 1 (Knops blood group)
  ENSP ID: ENSP00000436139
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGSLSSPRSFSVCQVENPNQCI

SEQ ID NO: 19309 - protein, 569 aa, Homo sapiens
  Payload ID: 3872
  Gene Symbol: CR1L
  Gene Name: complement component (3b/4b) receptor 1-like
  Uniprot ID: Q2VPA4
  ENSP ID: ENSP00000421736
MAPPVRLERPFPSRRFPGLLLAALVLLLSSFSDQCNVPEWLPFARPTNLTDDFEFPIGTYLNYECRPGYSGRPFSIICLKNSVWTSAKDKCKRKSCRNPPDPVNGMAHVIKDIQFRSQIKYSCPKGYRLIGSSSATCIISGNTVIWDNKTPVCDRIICGLPPTIANGDFTSISREYFHYGSVVTYHCNLGSRGKKVFELVGEPSIYCTSKDDQVGIWSGPAPQCIIPNKCTPPNVENGILVSDNRSLFSLNEVVEFRCQPGFGMKGPSHVKCQALNKWEPELPSCSRVCQPPPDVLHAERTQRDKDNFSPGQEVFYSCEPGYDLRGSTYLHCTPQGDWSPAAPRCEVKSCDDFLGQLPNGHVLFPLNLQLGAKVDFVCDEGFQLKGSSASYCVLAGMESLWNSSVPVCERKSCETPPVPVNGMVHVITDIHVGSRINYSCTTGHRLIGHSSAECILSGNTAHWSMKPPICQQIFCPNPPAILNGRHTGTPLGDIPYGKEVSYTCDPHPDRGMTFNLIGESTIRRTSEPHGNGVWSSPAPRCELPVGAGSHDALIVGKFYEVFAEEFCHL

SEQ ID NO: 19310 - protein, 388 aa, Homo sapiens
  Payload ID: 3872
  Gene Symbol: CR1L
  Gene Name: complement component (3b/4b) receptor 1-like
  ENSP ID: ENSP00000434864
IGTYLNYECRPGYSGRPFSIICLKNSVWTSAKDKCKRKSCRNPPDPVNGMAHVIKDIQFRSQIKYSCPKGYRLIGSSSATCIISGNTVIWDNKTPVCDRIICGLPPTIANGDFTSISREYFHYGSVVTYHCNLGSRGKKVFELVGEPSIYCTSKDDQVGIWSGPAPQCIIPNKCTPPNVENGILVSDNRSLFSLNEVVEFRCQPGFGMKGPSHVKCQALNKWEPELPSCSRVCQPPPDVLHAERTQRDKDNFSPGQEVFYSCEPGYDLRGSTYLHCTPQGDWSPAAPRCEVKSCDDFLGQLPNGHVLFPLNLQLGAKVDFVCDEGFQLKGSSASYCVLAGMESLWNSSVPVCERKSCETPPVPVNGMVHVITDIHVGSRINYSCTTGF

SEQ ID NO: 19311 - protein, 1092 aa, Homo sapiens
  Payload ID: 3873
  Gene Symbol: CR2
  Gene Name: complement component (3d/Epstein Barr virus) receptor 2
  Uniprot ID: P20023
  ENSP ID: ENSP00000356024
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKGCQSPPGLHHGRHTGGNTVFFVSGMTVDYTCDPGYLLVGNKSIHCMPSGNWSPSAPRCEETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRARNYYTDTSQKEAFHLEAREVYSVDPYNPAS

SEQ ID NO: 19312 - protein, 1033 aa, Homo sapiens
  Payload ID: 3873
  Gene Symbol: CR2
  Gene Name: complement component (3d/Epstein Barr virus) receptor 2
  Uniprot ID: P20023
  ENSP ID: ENSP00000356025
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRARNYYTDTSQKEAFHLEAREVYSVDPYNPAS

SEQ ID NO: 19313 - protein, 971 aa, Homo sapiens
  Payload ID: 3873
  Gene Symbol: CR2
  Gene Name: complement component (3d/Epstein Barr virus) receptor 2
  ENSP ID: ENSP00000356026
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRARNYYTDTSQKEAFHLEAREVYSVDPYNPAS

SEQ ID NO: 19314 - protein, 282 aa, Homo sapiens
  Payload ID: 3874
  Gene Symbol: C1QBP
  Gene Name: complement component 1, q subcomponent binding protein
  Uniprot ID: Q07021
  ENSP ID: ENSP00000225698
MLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 19315 - protein, 9 aa, Homo sapiens
  Payload ID: 3874
  Gene Symbol: C1QBP
  Gene Name: complement component 1, q subcomponent binding protein
  ENSP ID: ENSP00000458624
MSGGWELEL

SEQ ID NO: 19316 - protein, 178 aa, Homo sapiens
  Payload ID: 3874
  Gene Symbol: C1QBP
  Gene Name: complement component 1, q subcomponent binding protein
  ENSP ID: ENSP00000460308
MSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 19317 - protein, 177 aa, Homo sapiens
  Payload ID: 3874
  Gene Symbol: C1QBP
  Gene Name: complement component 1, q subcomponent binding protein
  ENSP ID: ENSP00000460638
MSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKS

SEQ ID NO: 19318 - protein, 245 aa, Homo sapiens
  Payload ID: 3875
  Gene Symbol: C1QA
  Gene Name: complement component 1, q subcomponent, A chain
  Uniprot ID: P02745
  ENSP ID: ENSP00000363773
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDPKKGHIYQGSEADSVFSGFLIFPSA

SEQ ID NO: 19319 - protein, 245 aa, Homo sapiens; identical to SEQ ID NO: 19318
  Payload ID: 3875
  Gene Symbol: C1QA
  Gene Name: complement component 1, q subcomponent, A chain
  Uniprot ID: P02745
  ENSP ID: ENSP00000385564

SEQ ID NO: 19320 - protein, 220 aa, Homo sapiens
  Payload ID: 3875
  Gene Symbol: C1QA
  Gene Name: complement component 1, q subcomponent, A chain
  ENSP ID: ENSP00000416841
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKD

SEQ ID NO: 19321 - protein, 253 aa, Homo sapiens
  Payload ID: 3876
  Gene Symbol: C1QB
  Gene Name: complement component 1, q subcomponent, B chain
  Uniprot ID: P02746
  ENSP ID: ENSP00000313967
MMMKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 19322 - protein, 228 aa, Homo sapiens
  Payload ID: 3876
  Gene Symbol: C1QB
  Gene Name: complement component 1, q subcomponent, B chain
  ENSP ID: ENSP00000404606
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKN

SEQ ID NO: 19323 - protein, 251 aa, Homo sapiens
  Payload ID: 3876
  Gene Symbol: C1QB
  Gene Name: complement component 1, q subcomponent, B chain
  ENSP ID: ENSP00000423689
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 19324 - protein, 153 aa, Homo sapiens
  Payload ID: 3876
  Gene Symbol: C1QB
  Gene Name: complement component 1, q subcomponent, B chain
  ENSP ID: ENSP00000426317
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEP

SEQ ID NO: 19325 - protein, 245 aa, Homo sapiens
  Payload ID: 3877
  Gene Symbol: C1QC
  Gene Name: complement component 1, q subcomponent, C chain
  Uniprot ID: P02747
  ENSP ID: ENSP00000363768
MDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDMVGIQGSDSVFSGFLLFPD

SEQ ID NO: 19326 - protein, 245 aa, Homo sapiens; identical to SEQ ID NO: 19325
  Payload ID: 3877
  Gene Symbol: C1QC
  Gene Name: complement component 1, q subcomponent, C chain
  Uniprot ID: P02747
  ENSP ID: ENSP00000363770

SEQ ID NO: 19327 - protein, 245 aa, Homo sapiens; identical to SEQ ID NO: 19325
  Payload ID: 3877
  Gene Symbol: C1QC
  Gene Name: complement component 1, q subcomponent, C chain
  Uniprot ID: P02747
  ENSP ID: ENSP00000363771

SEQ ID NO: 19328 - protein, 258 aa, Homo sapiens
  Payload ID: 3878
  Gene Symbol: C1QL1
  Gene Name: complement component 1, q subcomponent-like 1
  Uniprot ID: O75973
  ENSP ID: ENSP00000253407
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSD

SEQ ID NO: 19329 - protein, 287 aa, Homo sapiens
  Payload ID: 3879
  Gene Symbol: C1QL2
  Gene Name: complement component 1, q subcomponent-like 2
  Uniprot ID: Q7Z5L3
  ENSP ID: ENSP00000272520
MALGLLIAVPLLLQAAPRGAAHYEMMGTCRMICDPYTAAPGGEPPGAKAQPPGPSTAALEVMQDLSANPPPPFIQGPKGDPGRPGKPGPRGPPGEPGPPGPRGPPGEKGDSGRPGLPGLQLTAGTASGVGVVGGGAGVGGDSEGEVTSALSATFSGPKIAFYVGLKSPHEGYEVLKFDDVVTNLGNHYDPTTGKFSCQVRGIYFFTYHILMRGGDGTSMWADLCKNGQVRASAIAQDADQNYDYASNSVVLHLDSGDEVYVKLDGGKAHGGNNNKYSTFSGFLLYPD

SEQ ID NO: 19330 - protein, 255 aa, Homo sapiens
  Payload ID: 3880
  Gene Symbol: C1QL3
  Gene Name: complement component 1, q subcomponent-like 3
  Uniprot ID: Q5VWW1
  ENSP ID: ENSP00000298943
MVLLLVILIPVLVSSAGTSAHYEMLGTCRMVCDPYGGTKAPSTAATPDRGLMQSLPTFIQGPKGEAGRPGKAGPRGPPGEPGPPGPMGPPGEKGEPGRQGLPGPPGAPGLNAAGAISAATYSTVPKIAFYAGLKRQHEGYEVLKFDDVVTNLGNHYDPTTGKFTCSIPGIYFFTYHVLMRGGDGTSMWADLCKNNQVRASAIAQDADQNYDYASNSVVLHLEPGDEVYIKLDGGKAHGGNNNKYSTFSGFIIYAD

SEQ ID NO: 19331 - protein, 213 aa, Homo sapiens
  Payload ID: 3880
  Gene Symbol: C1QL3
  Gene Name: complement component 1, q subcomponent-like 3
  Uniprot ID: Q5VWW1
  ENSP ID: ENSP00000480149
MVLLLVILIPVLVSSAGTSAHYEMLGTCRMVCDPYGGTKAPSTAATPDRGLMQSLPTFIQGPPGAPGLNAAGAISAATYSTVPKIAFYAGLKRQHEGYEVLKFDDVVTNLGNHYDPTTGKFTCSIPGIYFFTYHVLMRGGDGTSMWADLCKNNQVRASAIAQDADQNYDYASNSVVLHLEPGDEVYIKLDGGKAHGGNNNKYSTFSGFIIYAD

SEQ ID NO: 19332 - protein, 238 aa, Homo sapiens
  Payload ID: 3881
  Gene Symbol: C1QL4
  Gene Name: complement component 1, q subcomponent-like 4
  Uniprot ID: Q86Z23
  ENSP ID: ENSP00000335285
MVLLLLVAIPLLVHSSRGPAHYEMLGRCRMVCDPHGPRGPGPDGAPASVPPFPPGAKGEVGRRGKAGLRGPPGPPGPRGPPGEPGRPGPPGPPGPGPGGVAPAAGYVPRIAFYAGLRRPHEGYEVLRFDDVVTNVGNAYEAASGKFTCPMPGVYFFAYHVLMRGGDGTSMWADLMKNGQVRASAIAQDADQNYDYASNSVILHLDVGDEVFIKLDGGKVHGGNTNKYSTFSGFIIYPD

SEQ ID NO: 19333 - protein, 705 aa, Homo sapiens
  Payload ID: 3882
  Gene Symbol: C1R
  Gene Name: complement component 1, r subcomponent
  Uniprot ID: P00736
  ENSP ID: ENSP00000438615
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 19334 - protein, 671 aa, Homo sapiens
  Payload ID: 3882
  Gene Symbol: C1R
  Gene Name: complement component 1, r subcomponent
  ENSP ID: ENSP00000438636
MWLLYLLVPALFCRAGGSIPIPQKLFGEVTSPLFPKPYPNNFETTTVITVPTGYRVKLVFQQFDLEPSEGCFYDYVKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 19335 - protein, 93 aa, Homo sapiens
  Payload ID: 3882
  Gene Symbol: C1R
  Gene Name: complement component 1, r subcomponent
  ENSP ID: ENSP00000439223
MSQGNKMLLTFHTDFSNEENGTIMFYKGFLAYYQAVDLDECASRSKSGEEDPQPQCQHLCHNYVGGYFCSCRPGYELQEDRHSCQAECSSELY

SEQ ID NO: 19336 - protein, 71 aa, Homo sapiens
  Payload ID: 3882
  Gene Symbol: C1R
  Gene Name: complement component 1, r subcomponent
  ENSP ID: ENSP00000441601
MSQGNKMLLTFHTDFSNEENGTIMFYKGFLAYYQAVDLDECASRSKSGEEDPQPQCQHLCHNYVGGYFCSC

SEQ ID NO: 19337 - protein, 156 aa, Homo sapiens
  Payload ID: 3882
  Gene Symbol: C1R
  Gene Name: complement component 1, r subcomponent
  ENSP ID: ENSP00000442946
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVGEEDPQPQCQHLCHN

SEQ ID NO: 19338 - protein, 49 aa, Homo sapiens
  Payload ID: 3882
  Gene Symbol: C1R
  Gene Name: complement component 1, r subcomponent
  ENSP ID: ENSP00000444009
MSQGNKMLLTFHTDFSNEENGTIMFYKGFLAYYQAVDLDECASRSKSGE

SEQ ID NO: 19339 - protein, 719 aa, Homo sapiens
  Payload ID: 3882
  Gene Symbol: C1R
  Gene Name: complement component 1, r subcomponent
  ENSP ID: ENSP00000444271
MSVRFRVGREENAQWWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 19340 - protein, 156 aa, Homo sapiens
  Payload ID: 3882
  Gene Symbol: C1R
  Gene Name: complement component 1, r subcomponent
  ENSP ID: ENSP00000445285
MWLLYLLVPALFCRAGGSIPIPQKLFGEVTSPLFPKPYPNNFETTTVITVPTGYRVKLVFQQFDLEPSEGCFYDYVKKEFMSQGNKMLLTFHTDFSNEENGTIMFYKGFLAYYQAVDLDECASRSKSGEEDPQPQCQHLCHNYVGGYFCSCRPGYE

SEQ ID NO: 19341 - protein, 144 aa, Homo sapiens
  Payload ID: 3882
  Gene Symbol: C1R
  Gene Name: complement component 1, r subcomponent
  ENSP ID: ENSP00000446356
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVGLW

SEQ ID NO: 19342 - protein, 487 aa, Homo sapiens
  Payload ID: 3883
  Gene Symbol: C1RL
  Gene Name: complement component 1, r subcomponent-like
  Uniprot ID: Q9NZP8
  ENSP ID: ENSP00000266542
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVAVNYSQPISEASRGSEAINAPGDNPAKVQNHCQEPYYQAAAAGALTCATPGTWKDRQDGEEVLQCMPVCGRPVTPIAQNQTTLGSSRAKLGNFPWQAFTSIHGRGGGALLGDRWILTAAHTIYPKDSVSLRKNQSVNVFLGHTAIDEMLKLGNHPVHRVVVHPDYRQNESHNFSGDIALLELQHSIPLGPNVLPVCLPDNETLYRSGLLGYVSGFGMEMGWLTTELKYSRLPVAPREACNAWLQKRQRPEVFSDNMFCVGDETQRHSVCQGDSGSVYVVWDNHAHHWVATGIVSWGIGCGEGYDFYTKVLSYVDWIKGVMNGKN

SEQ ID NO: 19343 - protein, 191 aa, Homo sapiens
  Payload ID: 3883
  Gene Symbol: C1RL
  Gene Name: complement component 1, r subcomponent-like
  ENSP ID: ENSP00000437398
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVGALTCATPGTWKDRQDGEEVLQCMPVCG

SEQ ID NO: 19344 - protein, 83 aa, Homo sapiens
  Payload ID: 3883
  Gene Symbol: C1RL
  Gene Name: complement component 1, r subcomponent-like
  ENSP ID: ENSP00000437569
GLRPGAVPGLCRGLCHNLIRRFGSKPVLWSARLPSGQAPWSEGVCILREEFAADLPHTAFLGEQDCPPPQGLPGPLPNRGCEL

SEQ ID NO: 19345 - protein, 110 aa, Homo sapiens
  Payload ID: 3883
  Gene Symbol: C1RL
  Gene Name: complement component 1, r subcomponent-like
  ENSP ID: ENSP00000438286
MPGPRVWGKYLWRSPHSKGCPGAISHSSVRIQASSVVSKAPLWAGPLVRGSFQPISEASRGSEAINAPGDNPAKVQNHCQEPYYQAAAAGCGSYADPITDQPSVRFSPQL

SEQ ID NO: 19346 - protein, 85 aa, Homo sapiens
  Payload ID: 3883
  Gene Symbol: C1RL
  Gene Name: complement component 1, r subcomponent-like
  ENSP ID: ENSP00000438951
  MOD_RES (1)..(1): Any amino acid
XPGLRPGAVPGLCRGLCHNLIRRFGSKPVLWSARLPSGQAPWSEGVCILREEFAADLPHTAFLGEQDCPPPQGLPGPLPNRGCEL

SEQ ID NO: 19347 - protein, 194 aa, Homo sapiens
  Payload ID: 3883
  Gene Symbol: C1RL
  Gene Name: complement component 1, r subcomponent-like
  ENSP ID: ENSP00000439180
  MOD_RES (1)..(1): Any amino acid
XSFVGSDPSQFCGQQGSPLGRPPGQREFVSSGRSLRLTFRTQPSSENKTAHLHKGFLALYQTVVCGRPVTPIAQNQTTLGSSRAKLGNFPWQAFTSIHGRGGGALLGDRWILTAAHTIYPKDSVSLRKNQSVNVFLGHTAIDEMLKLGNHPVHRVVVHPDYRQNESHNFSGDIALLELQHSIPLGPNVLPVCLP

SEQ ID NO: 19348 - protein, 314 aa, Homo sapiens
  Payload ID: 3883
  Gene Symbol: C1RL
  Gene Name: complement component 1, r subcomponent-like
  ENSP ID: ENSP00000441885
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVAVNYSQPISEASRGSEAINAPGDNPAKVQNHCQEPYYQAAAAASTPSLFLCLSSFTPQGHSPVQPQGPGKTDRMGRRFFSVCLSADGQSPPLPRIRRPSVLPEPSWATSPGKPSPVSTAVGAGPCWGTDGSSLLPTPSTPRTVFLSGRTRV

SEQ ID NO: 19349 - protein, 187 aa, Homo sapiens
  Payload ID: 3883
  Gene Symbol: C1RL
  Gene Name: complement component 1, r subcomponent-like
  ENSP ID: ENSP00000442611
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVGECPSWGCREGASVPSHDPGIFKP

SEQ ID NO: 19350 - protein, 66 aa, Homo sapiens
  Payload ID: 3883
  Gene Symbol: C1RL
  Gene Name: complement component 1, r subcomponent-like
  ENSP ID: ENSP00000444157
  MOD_RES (1)..(1): Any amino acid
XNPAKVQNHCQEPYYQAAAAGALTCATPGTWKDRQDGEEVLQCMPGCGSYADPITDQPSVRFSPQL

SEQ ID NO: 19351 - protein, 688 aa, Homo sapiens
  Payload ID: 3884
  Gene Symbol: C1S
  Gene Name: complement component 1, s subcomponent
  Uniprot ID: P09871
  ENSP ID: ENSP00000328173
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 19352 - protein, 688 aa, Homo sapiens; identical to SEQ ID NO: 19351
  Payload ID: 3884
  Gene Symbol: C1S
  Gene Name: complement component 1, s subcomponent
  Uniprot ID: P09871
  ENSP ID: ENSP00000354057

SEQ ID NO: 19353 - protein, 521 aa, Homo sapiens
  Payload ID: 3884
  Gene Symbol: C1S
  Gene Name: complement component 1, s subcomponent
  ENSP ID: ENSP00000384171
MKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 19354 - protein, 168 aa, Homo sapiens
  Payload ID: 3884
  Gene Symbol: C1S
  Gene Name: complement component 1, s subcomponent
  ENSP ID: ENSP00000384464
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDM

SEQ ID NO: 19355 - protein, 688 aa, Homo sapiens; identical to SEQ ID NO: 19351
  Payload ID: 3884
  Gene Symbol: C1S
  Gene Name: complement component 1, s subcomponent
  Uniprot ID: P09871
  ENSP ID: ENSP00000385035

SEQ ID NO: 19356 - protein, 355 aa, Homo sapiens
  Payload ID: 3884
  Gene Symbol: C1S
  Gene Name: complement component 1, s subcomponent
  ENSP ID: ENSP00000397921
  MOD_RES (1)..(1): Any amino acid
XSKVRRCRKPGPRDRQLTRVDKSPEMWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEK

SEQ ID NO: 19357 - protein, 100 aa, Homo sapiens
  Payload ID: 3884
  Gene Symbol: C1S
  Gene Name: complement component 1, s subcomponent
  ENSP ID: ENSP00000399892
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQ

SEQ ID NO: 19358 - protein, 103 aa, Homo sapiens
  Payload ID: 3884
  Gene Symbol: C1S
  Gene Name: complement component 1, s subcomponent
  ENSP ID: ENSP00000406643
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPY

SEQ ID NO: 19359 - protein, 157 aa, Homo sapiens
  Payload ID: 3884
  Gene Symbol: C1S
  Gene Name: complement component 1, s subcomponent
  ENSP ID: ENSP00000442298
MKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDG

SEQ ID NO: 19360 - protein, 682 aa, Homo sapiens [sequence omitted]

SEQ ID NO: 19361 - protein, 752 aa, Homo sapiens
  Payload ID: 3885
  Gene Symbol: C2
  Gene Name: complement component 2
  Uniprot ID: P06681
  ENSP ID: ENSP00000299367
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 19362 - protein, 752 aa, Homo sapiens; identical to SEQ ID NO: 19361
  Payload ID: 3885
  Gene Symbol: C2
  Gene Name: complement component 2
  Uniprot ID: P06681
  ENSP ID: ENSP00000364660

SEQ ID NO: 19363 - protein, 526 aa, Homo sapiens
  Payload ID: 3885
  Gene Symbol: C2
  Gene Name: complement component 2
  ENSP ID: ENSP00000372664
  MOD_RES (1)..(1): Any amino acid
XMVLFCLLFLYPAGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 19364 - protein, 525 aa, Homo sapiens
  Payload ID: 3885
  Gene Symbol: C2
  Gene Name: complement component 2
  ENSP ID: ENSP00000372850
MVLFCLLFLYPAGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 19365 - protein, 752 aa, Homo sapiens; identical to SEQ ID NO: 19361
  Payload ID: 3885
  Gene Symbol: C2
  Gene Name: complement component 2
  Uniprot ID: P06681
  ENSP ID: ENSP00000372853

SEQ ID NO: 19366 - protein, 525 aa, Homo sapiens; identical to SEQ ID NO: 19364
  Payload ID: 3885
  Gene Symbol: C2
  Gene Name: complement component 2
  ENSP ID: ENSP00000372858

SEQ ID NO: 19367 - protein, 158 aa, Homo sapiens
  Payload ID: 3885
  Gene Symbol: C2
  Gene Name: complement component 2
  ENSP ID: ENSP00000387374
MRALCIRETCSSELGFSRNWSRRKAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMV

SEQ ID NO: 19368 - protein, 139 aa, Homo sapiens
  Payload ID: 3885
  Gene Symbol: C2
  Gene Name: complement component 2
  ENSP ID: ENSP00000388286
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDG

SEQ ID NO: 19369 - protein, 84 aa, Homo sapiens
  Payload ID: 3885
  Gene Symbol: C2
  Gene Name: complement component 2
  ENSP ID: ENSP00000388727
MGTRSAIAAPRILCSRGLRSGSARATGSGVERSPSAANPTLMTSLRTWPLPWALPSPTCLGPPIPPRRQRKAWAVKSKSSALVI

SEQ ID NO: 19370 - protein, 125 aa, Homo sapiens
  Payload ID: 3885
  Gene Symbol: C2
  Gene Name: complement component 2
  ENSP ID: ENSP00000389650
MGPLMVLFCLLFLYPGLADSAPSCPQNVNISGGTFTLSHGWAPGSLLTYSCPQGLYPSPASRLCKSSGQWQTPGATRSLSKAVCKPGHCPNPGISLGAVRTGFRFGHGDKVRYRCSSNLVLTGSS

SEQ ID NO: 19371 - protein, 169 aa, Homo sapiens
  Payload ID: 3885
  Gene Symbol: C2
  Gene Name: complement component 2
  ENSP ID: ENSP00000389865
MRALCIRETCSSELGFSRNWSRRKAGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGG

SEQ ID NO: 19372 - protein, 139 aa, Homo sapiens; identical to SEQ ID NO: 19368
  Payload ID: 3885
  Gene Symbol: C2
  Gene Name: complement component 2
  ENSP ID: ENSP00000390302

SEQ ID NO: 19373 - protein, 145 aa, Homo sapiens
  Payload ID: 3885
  Gene Symbol: C2
  Gene Name: complement component 2
  ENSP ID: ENSP00000390659
  MOD_RES (1)..(1): Any amino acid
XGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGG

SEQ ID NO: 19374 - protein, 525 aa, Homo sapiens; identical to SEQ ID NO: 19364
  Payload ID: 3885
  Gene Symbol: C2
  Gene Name: complement component 2
  ENSP ID: ENSP00000391314

SEQ ID NO: 19375 - protein, 203 aa, Homo sapiens
  Payload ID: 3885
  Gene Symbol: C2
  Gene Name: complement component 2
  ENSP ID: ENSP00000391354
MGPLMVLFCLLFLYPGLADSAPSCPQNVNISGGTFTLSHGWAPGSLLTYSCPQGLYPSPASRLCKSSGQWQTPGATRSLSKAVCKPGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSV

SEQ ID NO: 19376 - protein, 139 aa, Homo sapiens; identical to SEQ ID NO: 19368
  Payload ID: 3885
  Gene Symbol: C2
  Gene Name: complement component 2
  ENSP ID: ENSP00000391400

SEQ ID NO: 19377 - protein, 158 aa, Homo sapiens; identical to SEQ ID NO: 19367
  Payload ID: 3885
  Gene Symbol: C2
  Gene Name: complement component 2
  ENSP ID: ENSP00000391508

SEQ ID NO: 19378 - protein, 125 aa, Homo sapiens; identical to SEQ ID NO: 19370
  Payload ID: 3885
  Gene Symbol: C2
  Gene Name: complement component 2
  ENSP ID: ENSP00000392182

SEQ ID NO: 19379 - protein, 538 aa, Homo sapiens
  Payload ID: 3885
  Gene Symbol: C2
  Gene Name: complement component 2
  Uniprot ID: P06681
  ENSP ID: ENSP00000392322
MRALCIRETCSSELGFSRNWSRRKAGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 19380 - protein, 125 aa, Homo sapiens; identical to SEQ ID NO: 19370
  Payload ID: 3885
  Gene Symbol: C2
  Gene Name: complement component 2
  ENSP ID: ENSP00000392445

SEQ ID NO: 19381 - protein, 752 aa, Homo sapiens; identical to SEQ ID NO: 19361
  Payload ID: 3885
  Gene Symbol: C2
  Gene Name: complement component 2
  Uniprot ID: P06681
  ENSP ID: ENSP00000392835

SEQ ID NO: 19382 - protein, 145 aa, Homo sapiens; identical to SEQ ID NO: 19373
  Payload ID: 3885
  Gene Symbol: C2
  Gene Name: complement component 2
  ENSP ID: ENSP00000393055
  MOD_RES (1)..(1): Any amino acid

SEQ ID NO: 19383 - protein, 134 aa, Homo sapiens
  Payload ID: 3885
  Gene Symbol: C2
  Gene Name: complement component 2
  ENSP ID: ENSP00000395426
  MOD_RES (1)..(1): Any amino acid
XGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMV

SEQ ID NO: 19384 - protein, 620 aa, Homo sapiens
  Payload ID: 3885
  Gene Symbol: C2
  Gene Name: complement component 2
  Uniprot ID: P06681
  ENSP ID: ENSP00000395683
MGPLMVLFCLLFLYPAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 19385 - protein, 169 aa, Homo sapiens; identical to SEQ ID NO: 19371
  Payload ID: 3885
  Gene Symbol: C2
  Gene Name: complement component 2
  ENSP ID: ENSP00000396369

SEQ ID NO: 19386 - protein, 525 aa, Homo sapiens; identical to SEQ ID NO: 19364
  Payload ID: 3885
  Gene Symbol: C2
  Gene Name: complement component 2
  ENSP ID: ENSP00000398098

SEQ ID NO: 19387 - protein, 169 aa, Homo sapiens; identical to SEQ ID NO: 19371
  Payload ID: 3885
  Gene Symbol: C2
  Gene Name: complement component 2
  ENSP ID: ENSP00000400097

SEQ ID NO: 19388 - protein, 525 aa, Homo sapiens; identical to SEQ ID NO: 19364
  Payload ID: 3885
  Gene Symbol: C2
  Gene Name: complement component 2
  ENSP ID: ENSP00000400362

SEQ ID NO: 19389 - protein, 139 aa, Homo sapiens; identical to SEQ ID NO: 19368
  Payload ID: 3885
  Gene Symbol: C2
  Gene Name: complement component 2
  ENSP ID: ENSP00000401708

SEQ ID NO: 19390 - protein, 752 aa, Homo sapiens; identical to SEQ ID NO: 19361
  Payload ID: 3885
  Gene Symbol: C2
  Gene Name: complement component 2
  Uniprot ID: P06681
  ENSP ID: ENSP00000402278

SEQ ID NO: 19391 - protein, 139 aa, Homo sapiens; identical to SEQ ID NO: 19368
  Payload ID: 3885
  Gene Symbol: C2
  Gene Name: complement component 2
  ENSP ID: ENSP00000403325

SEQ ID NO: 19392 - protein, 139 aa, Homo sapiens; identical to SEQ ID NO: 19368
  Payload ID: 3885
  Gene Symbol: C2
  Gene Name: complement component 2
  ENSP ID: ENSP00000403658

SEQ ID NO: 19393 - protein, 125 aa, Homo sapiens; identical to SEQ ID NO: 19370
  Payload ID: 3885
  Gene Symbol: C2
  Gene Name: complement component 2
  ENSP ID: ENSP00000404144

SEQ ID NO: 19394 - protein, 353 aa, Homo sapiens
  Payload ID: 3885
  Gene Symbol: C2
  Gene Name: complement component 2
  ENSP ID: ENSP00000404452
MGPLMVLFCLLFLYPAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIK

SEQ ID NO: 19395 - protein, 125 aa, Homo sapiens; identical to SEQ ID NO: 19370
  Payload ID: 3885
  Gene Symbol: C2
  Gene Name: complement component 2
  ENSP ID: ENSP00000405701

SEQ ID NO: 19396 - protein, 169 aa, Homo sapiens; identical to SEQ ID NO: 19371
  Payload ID: 3885
  Gene Symbol: C2
  Gene Name: complement component 2
  ENSP ID: ENSP00000405749

SEQ ID NO: 19397 - protein, 752 aa, Homo sapiens; identical to SEQ ID NO: 19361
  Payload ID: 3885
  Gene Symbol: C2
  Gene Name: complement component 2
  Uniprot ID: P06681
  ENSP ID: ENSP00000405800

SEQ ID NO: 19398 - protein, 158 aa, Homo sapiens; identical to SEQ ID NO: 19367
  Payload ID: 3885
  Gene Symbol: C2
  Gene Name: complement component 2
  ENSP ID: ENSP00000406121

SEQ ID NO: 19399 - protein, 328 aa, Homo sapiens
  Payload ID: 3885
  Gene Symbol: C2
  Gene Name: complement component 2
  ENSP ID: ENSP00000406190
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRVRNQESACSRGLPVLTISLCLLPLLRTPLTAHLLQEVFSDYTHAM

SEQ ID NO: 19400 - protein, 752 aa, Homo sapiens; identical to SEQ ID NO: 19361
  Payload ID: 3885
  Gene Symbol: C2
  Gene Name: complement component 2
  Uniprot ID: P06681
  ENSP ID: ENSP00000407961

SEQ ID NO: 19401 - protein, 353 aa, Homo sapiens; identical to SEQ ID NO: 19394
  Payload ID: 3885
  Gene Symbol: C2
  Gene Name: complement component 2
  ENSP ID: ENSP00000408250

SEQ ID NO: 19402 - protein, 125 aa, Homo sapiens; identical to SEQ ID NO: 19370
  Payload ID: 3885
  Gene Symbol: C2
  Gene Name: complement component 2
  ENSP ID: ENSP00000409041

SEQ ID NO: 19403 - protein, 353 aa, Homo sapiens; identical to SEQ ID NO: 19394
  Payload ID: 3885
  Gene Symbol: C2
  Gene Name: complement component 2
  ENSP ID: ENSP00000410904

SEQ ID NO: 19404 - protein, 158 aa, Homo sapiens; identical to SEQ ID NO: 19367
  Payload ID: 3885
  Gene Symbol: C2
  Gene Name: complement component 2
  ENSP ID: ENSP00000411298

SEQ ID NO: 19405 - protein, 353 aa, Homo sapiens; identical to SEQ ID NO: 19394
  Payload ID: 3885
  Gene Symbol: C2
  Gene Name: complement component 2
  ENSP ID: ENSP00000411376

SEQ ID NO: 19406 - protein, 139 aa, Homo sapiens; identical to SEQ ID NO: 19368
  Payload ID: 3885
  Gene Symbol: C2
  Gene Name: complement component 2
  ENSP ID: ENSP00000412289

SEQ ID NO: 19407 - protein, 353 aa, Homo sapiens; identical to SEQ ID NO: 19394
  Payload ID: 3885
  Gene Symbol: C2
  Gene Name: complement component 2
  ENSP ID: ENSP00000413295

SEQ ID NO: 19408 - protein, 353 aa, Homo sapiens; identical to SEQ ID NO: 19394
  Payload ID: 3885
  Gene Symbol: C2
  Gene Name: complement component 2
  ENSP ID: ENSP00000413482

SEQ ID NO: 19409 - protein, 158 aa, Homo sapiens; identical to SEQ ID NO: 19367
  Payload ID: 3885
  Gene Symbol: C2
  Gene Name: complement component 2
  ENSP ID: ENSP00000413995

SEQ ID NO: 19410 - protein, 525 aa, Homo sapiens; identical to SEQ ID NO: 19364
  Payload ID: 3885
  Gene Symbol: C2
  Gene Name: complement component 2
  ENSP ID: ENSP00000416484

SEQ ID NO: 19411 - protein, 134 aa, Homo sapiens; identical to SEQ ID NO: 19383
  Payload ID: 3885
  Gene Symbol: C2
  Gene Name: complement component 2
  ENSP ID: ENSP00000416938
  MOD_RES (1)..(1): Any amino acid

SEQ ID NO: 19412 - protein, 463 aa, Homo sapiens
  Payload ID: 3885
  Gene Symbol: C2
  Gene Name: complement component 2
  ENSP ID: ENSP00000417482
MGTRSAIAAPRILCSRGLRSGSARATGSGVERSPSAANPTLMTSLRTWPLPWALPSPTCLGPPIPPRRQRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCK

SEQ ID NO: 19413 - protein, 160 aa, Homo sapiens
  Payload ID: 3885
  Gene Symbol: C2
  Gene Name: complement component 2
  ENSP ID: ENSP00000417790
  MOD_RES (1)..(1): Any amino acid
XLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLAPKPQESGDFPLPHQTSMPSGWASWMWTGEN

SEQ ID NO: 19414 - protein, 104 aa, Homo sapiens
  Payload ID: 3885
  Gene Symbol: C2
  Gene Name: complement component 2
  ENSP ID: ENSP00000418332
MGPLMVLFCLLFLYPGLADSAPSCPQNVNISGGTFTLSHGWAPGSLLTYSCPQGLYPSPASRLCKSSGQWQTPGATRSLSKAVCKREAPCGLCSGCALSSPCLL

SEQ ID NO: 19415 - protein, 506 aa, Homo sapiens
  Payload ID: 3885
  Gene Symbol: C2
  Gene Name: complement component 2
  ENSP ID: ENSP00000418923
MGTRSAIAAPRILCSRGLRSGSARATGSGVERSPSAAIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 19416 - protein, 136 aa, Homo sapiens
  Payload ID: 3885
  Gene Symbol: C2
  Gene Name: complement component 2
  ENSP ID: ENSP00000419048
MGRPGRAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESA

SEQ ID NO: 19417 - protein, 84 aa, Homo sapiens; identical to SEQ ID NO: 19369
  Payload ID: 3885
  Gene Symbol: C2
  Gene Name: complement component 2
  ENSP ID: ENSP00000420305

SEQ ID NO: 19418 - protein, 620 aa, Homo sapiens; identical to SEQ ID NO: 19384
  Payload ID: 3885
  Gene Symbol: C2
  Gene Name: complement component 2
  Uniprot ID: P06681
  ENSP ID: ENSP00000446639

SEQ ID NO: 19419 - protein, 620 aa, Homo sapiens; identical to SEQ ID NO: 19384
  Payload ID: 3885
  Gene Symbol: C2
  Gene Name: complement component 2
  Uniprot ID: P06681
  ENSP ID: ENSP00000446728

SEQ ID NO: 19420 - protein, 506 aa, Homo sapiens; identical to SEQ ID NO: 19415
  Payload ID: 3885
  Gene Symbol: C2
  Gene Name: complement component 2
  ENSP ID: ENSP00000447134

SEQ ID NO: 19421 - protein, 723 aa, Homo sapiens
  Payload ID: 3885
  Gene Symbol: C2
  Gene Name: complement component 2
  ENSP ID: ENSP00000447458
MAGLLGAFSPTPAPRACTHPQHHGCARAADSGRPQEPPGLCLRRSANVRLPVGFAQAVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 19422 - protein, 620 aa, Homo sapiens; identical to SEQ ID NO: 19384
  Payload ID: 3885
  Gene Symbol: C2
  Gene Name: complement component 2
  Uniprot ID: P06681
  ENSP ID: ENSP00000447632

SEQ ID NO: 19423 - protein, 723 aa, Homo sapiens; identical to SEQ ID NO: 19421
  Payload ID: 3885
  Gene Symbol: C2
  Gene Name: complement component 2
  ENSP ID: ENSP00000448602

SEQ ID NO: 19424 - protein, 620 aa, Homo sapiens; identical to SEQ ID NO: 19384
  Payload ID: 3885
  Gene Symbol: C2
  Gene Name: complement component 2
  Uniprot ID: P06681
  ENSP ID: ENSP00000449286

SEQ ID NO: 19425 - protein, 723 aa, Homo sapiens; identical to SEQ ID NO: 19421
  Payload ID: 3885
  Gene Symbol: C2
  Gene Name: complement component 2
  ENSP ID: ENSP00000449345

SEQ ID NO: 19426 - protein, 723 aa, Homo sapiens; identical to SEQ ID NO: 19421
  Payload ID: 3885
  Gene Symbol: C2
  Gene Name: complement component 2
  ENSP ID: ENSP00000449366

SEQ ID NO: 19427 - protein, 620 aa, Homo sapiens; identical to SEQ ID NO: 19384
  Payload ID: 3885
  Gene Symbol: C2
  Gene Name: complement component 2
  Uniprot ID: P06681
  ENSP ID: ENSP00000449715

SEQ ID NO: 19428 - protein, 723 aa, Homo sapiens; identical to SEQ ID NO: 19421
  Payload ID: 3885
  Gene Symbol: C2
  Gene Name: complement component 2
  ENSP ID: ENSP00000449823

SEQ ID NO: 19429 - protein, 506 aa, Homo sapiens; identical to SEQ ID NO: 19415
  Payload ID: 3885
  Gene Symbol: C2
  Gene Name: complement component 2
  ENSP ID: ENSP00000449940

SEQ ID NO: 19430 - protein, 723 aa, Homo sapiens; identical to SEQ ID NO: 19421
  Payload ID: 3885
  Gene Symbol: C2
  Gene Name: complement component 2
  ENSP ID: ENSP00000450180

SEQ ID NO: 19431 - protein, 620 aa, Homo sapiens; identical to SEQ ID NO: 19384
  Payload ID: 3885
  Gene Symbol: C2
  Gene Name: complement component 2
  Uniprot ID: P06681
  ENSP ID: ENSP00000450387

SEQ ID NO: 19432 - protein, 506 aa, Homo sapiens; identical to SEQ ID NO: 19415
  Payload ID: 3885
  Gene Symbol: C2
  Gene Name: complement component 2
  ENSP ID: ENSP00000478351

SEQ ID NO: 19433 - protein, 538 aa, Homo sapiens; identical to SEQ ID NO: 19379
  Payload ID: 3885
  Gene Symbol: C2
  Gene Name: complement component 2
  Uniprot ID: P06681
  ENSP ID: ENSP00000480739

SEQ ID NO: 19434 - protein, 538 aa, Homo sapiens; identical to SEQ ID NO: 19379
  Payload ID: 3885
  Gene Symbol: C2
  Gene Name: complement component 2
  Uniprot ID: P06681
  ENSP ID: ENSP00000481651

SEQ ID NO: 19435 - protein, 506 aa, Homo sapiens; identical to SEQ ID NO: 19415
  Payload ID: 3885
  Gene Symbol: C2
  Gene Name: complement component 2
  ENSP ID: ENSP00000482072

SEQ ID NO: 19436 - protein, 506 aa, Homo sapiens; identical to SEQ ID NO: 19415
  Payload ID: 3885
  Gene Symbol: C2
  Gene Name: complement component 2
  ENSP ID: ENSP00000482188

SEQ ID NO: 19437 - protein, 538 aa, Homo sapiens; identical to SEQ ID NO: 19379
  Payload ID: 3885
  Gene Symbol: C2
  Gene Name: complement component 2
  Uniprot ID: P06681
  ENSP ID: ENSP00000482616

SEQ ID NO: 19438 - protein, 506 aa, Homo sapiens; identical to SEQ ID NO: 19415
  Payload ID: 3885
  Gene Symbol: C2
  Gene Name: complement component 2
  ENSP ID: ENSP00000483004

SEQ ID NO: 19439 - protein, 538 aa, Homo sapiens; identical to SEQ ID NO: 19379
  Payload ID: 3885
  Gene Symbol: C2
  Gene Name: complement component 2
  Uniprot ID: P06681
  ENSP ID: ENSP00000483231

SEQ ID NO: 19440 - protein, 1663 aa, Homo sapiens
  Payload ID: 3886
  Gene Symbol: C3
  Gene Name: complement component 3
  Uniprot ID: P01024
  ENSP ID: ENSP00000245907
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 19441 - protein, 100 aa, Homo sapiens
  Payload ID: 3886
  Gene Symbol: C3
  Gene Name: complement component 3
  ENSP ID: ENSP00000469482
  MOD_RES (1)..(1): Any amino acid
XFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPK

SEQ ID NO: 19442 - protein, 192 aa, Homo sapiens
  Payload ID: 3886
  Gene Symbol: C3
  Gene Name: complement component 3
  ENSP ID: ENSP00000469744
ITHRIHWESASLLRSEETKENEGFTVTAEGKGQGTLSVVTMYHAKAKDQLTCNKFDLKVTIKPAPETGIPSPIFLSSVFLEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNL

SEQ ID NO: 19443 - protein, 101 aa, Homo sapiens
  Payload ID: 3886
  Gene Symbol: C3
  Gene Name: complement component 3
  ENSP ID: ENSP00000471384
NNEKDMALTAFVLISLQEAKDICEEQVNSLPGSITKAGDFLEANYMNLQRSYTVAIAGYALAQMGRLKGPLLNKFLTTAKDEENQKQCQDLGAFTESMVVF

SEQ ID NO: 19444 - protein, 103 aa, Homo sapiens
  Payload ID: 3886
  Gene Symbol: C3
  Gene Name: complement component 3
  ENSP ID: ENSP00000472044
MVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGST

SEQ ID NO: 19445 - protein, 482 aa, Homo sapiens
  Payload ID: 3887
  Gene Symbol: C3AR1
  Gene Name: complement component 3a receptor 1
  Uniprot ID: Q16581
  ENSP ID: ENSP00000302079
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTFRVAVVVVAVFLVCWTPYHIFGVLSLLTDPETPLGKTLMSWDHVCIALASANSCFNPFLYALLGKDFRKKARQSIQGILEAAFSEELTRSTHCPSNNVISERNSTTV

SEQ ID NO: 19446 - protein, 146 aa, Homo sapiens
  Payload ID: 3887
  Gene Symbol: C3AR1
  Gene Name: complement component 3a receptor 1
  ENSP ID: ENSP00000444500
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCI

SEQ ID NO: 19447 - protein, 597 aa, Homo sapiens
  Payload ID: 3888
  Gene Symbol: C4BPA
  Gene Name: complement component 4 binding protein, alpha
  Uniprot ID: P04003
  ENSP ID: ENSP00000356037
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTSRCEVQDRGVGWSHPLPQCEIVKCKPPPDIRNGRHSGEENFYAYGFSVTYSCDPRFSLLGHASISCTVENETIGVWRPSPPTCEKITCRKPDVSHGEMVSGFGPIYNYKDTIVFKCQKGFVLRGSSVIHCDADSKWNPSPPACEPNSCINLPDIPHASWETYPRPTKEDVYVVGTVLRYRCHPGYKPTTDEPTTVICQKNLRWTPYQGCEALCCPEPKLNNGEITQHRKSRPANHCVYFYGDEISFSCHETSRFSAICQGDGTWSPRTPSCGDICNFPPKIAHGHYKQSSSYSFFKEEIIYECDKGYILVGQAKLSCSYSHWSAPAPQCKALCRKPELVNGRLSVDKDQYVEPENVTIQCDSGYGVVGPQSITCSGNRTWYPEVPKCEWETPEGCEQVLTGKRLMQCLPNPEDVKMALEVYKLSLEIEQLELQRDSARQSTLDKEL

SEQ ID NO: 19448 - protein, 118 aa, Homo sapiens
  Payload ID: 3888
  Gene Symbol: C4BPA
  Gene Name: complement component 4 binding protein, alpha
  ENSP ID: ENSP00000395968
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCILDTGFHHIG

SEQ ID NO: 19449 - protein, 152 aa, Homo sapiens
  Payload ID: 3888
  Gene Symbol: C4BPA
  Gene Name: complement component 4 binding protein, alpha
  ENSP ID: ENSP00000403386
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTS

SEQ ID NO: 19450 - protein, 252 aa, Homo sapiens
  Payload ID: 3889
  Gene Symbol: C4BPB
  Gene Name: complement component 4 binding protein, beta
  Uniprot ID: P20851
  ENSP ID: ENSP00000243611
MFFWCACCLMVAWRVSASDAEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVDGEWSSALPVCKLIQEAPKPECEKALLAFQESKNLCEAMENFMQQLKESGMTMEELKYSLELKKAELKAKLL

SEQ ID NO: 19451 - protein, 251 aa, Homo sapiens
  Payload ID: 3889
  Gene Symbol: C4BPB
  Gene Name: complement component 4 binding protein, beta
  Uniprot ID: P20851
  ENSP ID: ENSP00000356043
MFFWCACCLMVAWRVSASDEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVDGEWSSALPVCKLIQEAPKPECEKALLAFQESKNLCEAMENFMQQLKESGMTMEELKYSLELKKAELKAKLL

SEQ ID NO: 19452 - protein, 252 aa, Homo sapiens; identical to SEQ ID NO: 19450
  Payload ID: 3889
  Gene Symbol: C4BPB
  Gene Name: complement component 4 binding protein, beta
  Uniprot ID: P20851
  ENSP ID: ENSP00000356045

SEQ ID NO: 19453 - protein, 252 aa, Homo sapiens; identical to SEQ ID NO: 19450
  Payload ID: 3889
  Gene Symbol: C4BPB
  Gene Name: complement component 4 binding protein, beta
  Uniprot ID: P20851
  ENSP ID: ENSP00000375790

SEQ ID NO: 19454 - protein, 181 aa, Homo sapiens
  Payload ID: 3889
  Gene Symbol: C4BPB
  Gene Name: complement component 4 binding protein, beta
  ENSP ID: ENSP00000392237
MFFWCACCLMVAWRVSASDAEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVD

SEQ ID NO: 19455 - protein, 1744 aa, Homo sapiens
  Payload ID: 3890
  Gene Symbol: C4A
  Gene Name: complement component 4A (Rodgers blood group)
  ENSP ID: ENSP00000364444
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIEWPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 19456 - protein, 1744 aa, Homo sapiens [sequence omitted]

SEQ ID NO: 19457 - protein, 1744 aa, Homo sapiens
  Payload ID: 3890
  Gene Symbol: C4A
  Gene Name: complement component 4A (Rodgers blood group)
  Uniprot ID: P0C0L4
  ENSP ID: ENSP00000388662
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 19458 - protein, 1744 aa, Homo sapiens
  Payload ID: 3890
  Gene Symbol: C4A
  Gene Name: complement component 4A (Rodgers blood group)
  Uniprot ID: P0C0L4
  ENSP ID: ENSP00000396688
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 19459 - protein, 1698 aa, Homo sapiens
  Payload ID: 3890
  Gene Symbol: C4A
  Gene Name: complement component 4A (Rodgers blood group)
  Uniprot ID: P0C0L4
  ENSP ID: ENSP00000420212
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 19460 - protein, 1698 aa, Homo sapiens [sequence omitted]

SEQ ID NO: 19461 - protein, 1698 aa, Homo sapiens
  Payload ID: 3890
  Gene Symbol: C4A
  Gene Name: complement component 4A (Rodgers blood group)
  ENSP ID: ENSP00000448276
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 19462 - protein, 1698 aa, Homo sapiens
  Payload ID: 3890
  Gene Symbol: C4A
  Gene Name: complement component 4A (Rodgers blood group)
  ENSP ID: ENSP00000449828
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIEWPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 19463 - protein, 1744 aa, Homo sapiens; identical to SEQ ID NO: 19455
  Payload ID: 3890
  Gene Symbol: C4A
  Gene Name: complement component 4A (Rodgers blood group)
  ENSP ID: ENSP00000484103

SEQ ID NO: 19464 - protein, 1744 aa, Homo sapiens
  Payload ID: 3891
  Gene Symbol: C4B
  Gene Name: complement component 4B (Chido blood group)
  Uniprot ID: P0C0L5
  ENSP ID: ENSP00000364321
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 19465 - protein, 1698 aa, Homo sapiens
  Payload ID: 3891
  Gene Symbol: C4B
  Gene Name: complement component 4B (Chido blood group)
  ENSP ID: ENSP00000391933
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAATAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 19466 - protein, 1744 aa, Homo sapiens
  Payload ID: 3891
  Gene Symbol: C4B
  Gene Name: complement component 4B (Chido blood group)
  Uniprot ID: P0C0L5
  ENSP ID: ENSP00000407942
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAATAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 19467 - protein, 1744 aa, Homo sapiens [sequence omitted]

SEQ ID NO: 19468 - protein, 1744 aa, Homo sapiens; identical to SEQ ID NO: 19466
  Payload ID: 3891
  Gene Symbol: C4B
  Gene Name: complement component 4B (Chido blood group)
  Uniprot ID: P0C0L5
  ENSP ID: ENSP00000415941

SEQ ID NO: 19469 - protein, 1698 aa, Homo sapiens
  Payload ID: 3891
  Gene Symbol: C4B
  Gene Name: complement component 4B (Chido blood group)
  ENSP ID: ENSP00000446528
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKANSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 19470 - protein, 1698 aa, Homo sapiens
  Payload ID: 3891
  Gene Symbol: C4B
  Gene Name: complement component 4B (Chido blood group)
  ENSP ID: ENSP00000447600
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIEYPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 19471 - protein, 1698 aa, Homo sapiens; identical to SEQ ID NO: 19465
  Payload ID: 3891
  Gene Symbol: C4B
  Gene Name: complement component 4B (Chido blood group)
  ENSP ID: ENSP00000449523

SEQ ID NO: 19472 - protein, 1744 aa, Homo sapiens; identical to SEQ ID NO: 19464
  Payload ID: 3892
  Gene Symbol: C4B_2
  Gene Name: complement component 4B (Chido blood group), copy 2
  Uniprot ID: P0C0L5
  ENSP ID: ENSP00000412786

SEQ ID NO: 19473 - protein, 1698 aa, Homo sapiens; identical to SEQ ID NO: 19470
  Payload ID: 3892
  Gene Symbol: C4B_2
  Gene Name: complement component 4B (Chido blood group), copy 2
  ENSP ID: ENSP00000449433

SEQ ID NO: 19474 - protein, 1676 aa, Homo sapiens
  Payload ID: 3893
  Gene Symbol: C5
  Gene Name: complement component 5
  Uniprot ID: P01031
  ENSP ID: ENSP00000223642
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 19475 - protein, 350 aa, Homo sapiens
  Payload ID: 3894
  Gene Symbol: C5AR1
  Gene Name: complement component 5a receptor 1
  Uniprot ID: P21730
  ENSP ID: ENSP00000347197
MDSFNYTTPDYGHYDDKDTLDLNTPVDKTSNTLRVPDILALVIFAVVFLVGVLGNALVVWVTAFEAKRTINAIWFLNLAVADFLSCLALPILFTSIVQHHHWPFGGAACSILPSLILLNMYASILLLATISADRFLLVFKPIWCQNFRGAGLAWIACAVAWGLALLLTIPSFLYRVVREEYFPPKVLCGVDYSHDKRRERAVAIVRLVLGFLWPLLTLTICYTFILLRTWSRRATRSTKTLKVVVAVVASFFIFWLPYQVTGIMMSFLEPSSPTFLLLKKLDSLCVSFAYINCCINPIIYVVAGQGFQGRLRKSLPSLLRNVLTEESVVRESKSFTRSTVDTMAQKTQAV

SEQ ID NO: 19476 - protein, 17 aa, Homo sapiens
  Payload ID: 3894
  Gene Symbol: C5AR1
  Gene Name: complement component 5a receptor 1
  ENSP ID: ENSP00000470613
MYASILLLATISADRFL

SEQ ID NO: 19477 - protein, 337 aa, Homo sapiens [sequence omitted]

SEQ ID NO: 19478 - protein, 337 aa, Homo sapiens [sequence omitted]

SEQ ID NO: 19479 - protein, 934 aa, Homo sapiens
  Payload ID: 3896
  Gene Symbol: C6
  Gene Name: complement component 6
  Uniprot ID: P13671
  ENSP ID: ENSP00000263413
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTAPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEVQTAEDDLKTDFYKDLTSLGHNENQQGSFSSQGGSSFSVPIFYSSKRSENINHNSAFKQAIQASHKKDSSFIRIHKVMKVLNFTTKAKDLHLSDVFLKALNHLPLEYNSALYSRIFDDFGTHYFTSGSLGGVYDLLYQFSSEELKNSGLTEEEAKHCVRIETKKRVLFAKKTKVEHRCTTNKLSEKHEGSFIQGAEKSISLIRGGRSEYGAALAWEKGSSGLEEKTFSEWLESVKENPAVIDFELAPIVDLVRNIPCAVTKRNNLRKALQEYAAKFDPCQCAPCPNNGRPTLSGTECLCVCQSGTYGENCEKQSPDYKSNAVDGQWGCWSSWSTCDATYKRSRTRECNNPAPQRGGKRCEGEKRQEEDCTFSIMENNGQPCINDDEEMKEVDLPEIEADSGCPQPVPPENGFIRNEKQLYLVGEDVEISCLTGFETVGYQYFRCLPDGTWRQGDVECQRTECIKPVVQEVLTITPFQRLYRIGESIELTCPKGFVVAGPSRYTCQGNSWTPPISNSLTCEKDTLTKLKGHCQLGQKQSGSECICMSPEEDCSHHSEDLCVFDTDSNDYFTSPACKFLAEKCLNNQQLHFLHIGSCQDGRQLEWGLERTRLSSNSTKKESCGYDTCYDWEKCSASTSKCVCLLPPQCFKGGNQLYCVKMGSSTSEKTLNICEVGTIRCANRKMEILHPGKCLA

SEQ ID NO: 19480 - protein, 934 aa, Homo sapiens; identical to SEQ ID NO: 19479
  Payload ID: 3896
  Gene Symbol: C6
  Gene Name: complement component 6
  Uniprot ID: P13671
  ENSP ID: ENSP00000338861

SEQ ID NO: 19481 - protein, 133 aa, Homo sapiens
  Payload ID: 3896
  Gene Symbol: C6
  Gene Name: complement component 6
  ENSP ID: ENSP00000396565
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTAPLVAFQPCIPSKLC

SEQ ID NO: 19482 - protein, 31 aa, Homo sapiens
  Payload ID: 3896
  Gene Symbol: C6
  Gene Name: complement component 6
  ENSP ID: ENSP00000401578
MARRSVLYFILLNALINKGQACFCDHYAWTQ

SEQ ID NO: 19483 - protein, 843 aa, Homo sapiens
  Payload ID: 3897
  Gene Symbol: C7
  Gene Name: complement component 7
  Uniprot ID: P10643
  ENSP ID: ENSP00000322061
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVINTKSFGGQCRKVFSGDGKDFYRLSGNVLSYTFQVKINNDFNYEFYNSTWSYVKHTSTEHTSSSRKRSFFRSSSSSSRSYTSHTNEIHKGKSYQLLVVENTVEVAQFINNNPEFLQLAEPFWKELSHLPSLYDYSAYRRLIDQYGTHYLQSGSLGGEYRVLFYVDSEKLKQNDFNSVEEKKCKSSGWHFVVKFSSHGCKELENALKAASGTQNNVLRGEPFIRGGGAGFISGLSYLELDNPAGNKRRYSAWAESVTNLPQVIKQKLTPLYELVKEVPCASVKKLYLKWALEEYLDEFDPCHCRPCQNGGLATVEGTHCLCHCKPYTFGAACEQGVLVGNQAGGVDGGWSCWSSWSPCVQGKKTRSRECNNPPPSGGGRSCVGETTESTQCEDEELEHLRLLEPHCFPLSLVPTEFCPSPPALKDGFVQDEGTMFPVGKNVVYTCNEGYSLIGNPVARCGEDLRWLVGEMHCQKIACVLPVLMDGIQSHPQKPFYTVGEKVTVSCSGGMSLEGPSAFLCGSSLKWSPEMKNARCVQKENPLTQAVPKCQRWEKLQNSRCVCKMPYECGPSLDVCAQDERSKRILPLTVCKMHVLHCQGRNYTLTGRDSCTLPASAEKACGACPLWGKCDAESSKCVCREASECEEEGFSICVEVNGKEQTMSECEAGALRCRGQSISVTSIRPCAAETQ

SEQ ID NO: 19484 - protein, 584 aa, Homo sapiens
  Payload ID: 3898
  Gene Symbol: C8A
  Gene Name: complement component 8, alpha polypeptide
  Uniprot ID: P07357
  ENSP ID: ENSP00000354458
MFAVVFFILSLMTCQPGVTAQEKVNQRVRRAATPAAVTCQLSNWSEWTDCFPCQDKKYRHRSLLQPNKFGGTICSGDIWDQASCSSSTTCVRQAQCGQDFQCKETGRCLKRHLVCNGDQDCLDGSDEDDCEDVRAIDEDCSQYEPIPGSQKAALGYNILTQEDAQSVYDASYYGGQCETVYNGEWRELRYDSTCERLYYGDDEKYFRKPYNFLKYHFEALADTGISSEFYDNANDLLSKVKKDKSDSFGVTIGIGPAGSPLLVGVGVSHSQDTSFLNELNKYNEKKFIFTRIFTKVQTAHFKMRKDDIMLDEGMLQSLMELPDQYNYGMYAKFINDYGTHYITSGSMGGIYEYILVIDKAKMESLGITSRDITTCFGGSLGIQYEDKINVGGGLSGDHCKKFGGGKTERARKAMAVEDIISRVRGGSSGWSGGLAQNRSTITYRSWGRSLKYNPVVIDFEMQPIHEVLRHTSLGPLEAKRQNLRRALDQYLMEFNACRCGPCFNNGVPILEGTSCRCQCRLGSLGAACEQTQTEGAKADGSWSCWSSWSVCRAGIQERRRECDNPAPQNGGASCPGRKVQTQAC

SEQ ID NO: 19485 - protein, 591 aa, Homo sapiens
  Payload ID: 3899
  Gene Symbol: C8B
  Gene Name: complement component 8, beta polypeptide
  Uniprot ID: P07358
  ENSP ID: ENSP00000360281
MKNSRTWAWRAPVELFLLCAALGCLSLPGSRGERPHSFGSNAVNKSFAKSRQMRSVDVTLMPIDCELSSWSSWTTCDPCQKKRYRYAYLLQPSQFHGEPCNFSDKEVEDCVTNRPCGSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 19486 - protein, 529 aa, Homo sapiens
  Payload ID: 3899
  Gene Symbol: C8B
  Gene Name: complement component 8, beta polypeptide
  ENSP ID: ENSP00000440113
MDTCMTLAFTLSGRFFMLLSQYRYAYLLQPSQFHGEPCNFSDKEVEDCVTNRPCGSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 19487 - protein, 539 aa, Homo sapiens
  Payload ID: 3899
  Gene Symbol: C8B
  Gene Name: complement component 8, beta polypeptide
  ENSP ID: ENSP00000442548
MRSVDVTLMPIDCELSSWSSWTTCDPCQKKRYRYAYLLQPSQFHGEPCNFSDKEVEDCVTNRPCGSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 19488 - protein, 202 aa, Homo sapiens
  Payload ID: 3900
  Gene Symbol: C8G
  Gene Name: complement component 8, gamma polypeptide
  Uniprot ID: P07360
  ENSP ID: ENSP00000224181
MLPPGTATLLTLLLAAGSLGQKPQRPRRPASPISTIQPKANFDAQQFAGTWLLVAVGSACRFLQEQGHRAEATTLHVAPQGTAMAVSTFRKLDGICWQVRQLYGDTGVLGRFLLQARDARGAVHVVVAETDYQSFAVLYLERAGQLSVKLYARSLPVSDSVLSGFEQRVQEAHLTEDQIFYFPKYGFCEAADQFHVLDEVRR

SEQ ID NO: 19489 - protein, 164 aa, Homo sapiens
  Payload ID: 3900
  Gene Symbol: C8G
  Gene Name: complement component 8, gamma polypeptide
  ENSP ID: ENSP00000360697
MLPPGTATLLTLLLAAGSLGQKPQRPRRPASPISTIQPKANFDAQQFAGTWLLVAVGSACRFLQEQGHRAEATTLHVAPQGTAMAVSTFRKLDGICWQVRQLYGDTGVLGRFLLQARDARGAVHVVVAETDYQSFAVLYLERAGQLSVKLYGAQGVVTDRPGVG

SEQ ID NO: 19490 - protein, 559 aa, Homo sapiens
  Payload ID: 3901
  Gene Symbol: C9
  Gene Name: complement component 9
  Uniprot ID: P02748
  ENSP ID: ENSP00000263408
MSACRSFAVAICILEISILTAQYTTSYDPELTESSGSASHIDCRMSPWSEWSQCDPCLRQMFRSRSIEVFGQFNGKRCTDAVGDRRQCVPTEPCEDAEDDCGNDFQCSTGRCIKMRLRCNGDNDCGDFSDEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 19491 - protein, 589 aa, Homo sapiens
  Payload ID: 3902
  Gene Symbol: CFB
  Gene Name: complement factor B
  ENSP ID: ENSP00000364592
MGSNLSPQLCLMPFILGLLSGGVTTTPWSLAQPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYG

SEQ ID NO: 19492 - protein, 589 aa, Homo sapiens; identical to SEQ ID NO: 19491
  Payload ID: 3902
  Gene Symbol: CFB
  Gene Name: complement factor B
  ENSP ID: ENSP00000364604

SEQ ID NO: 19493 - protein, 764 aa, Homo sapiens [sequence omitted]

SEQ ID NO: 19494 - protein, 764 aa, Homo sapiens
  Payload ID: 3902
  Gene Symbol: CFB
  Gene Name: complement factor B
  Uniprot ID: P00751
  ENSP ID: ENSP00000388352
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 19495 - protein, 764 aa, Homo sapiens; identical to SEQ ID NO: 19494
  Payload ID: 3902
  Gene Symbol: CFB
  Gene Name: complement factor B
  Uniprot ID: P00751
  ENSP ID: ENSP00000389604

SEQ ID NO: 19496 - protein, 764 aa, Homo sapiens; identical to SEQ ID NO: 19494
  Payload ID: 3902
  Gene Symbol: CFB
  Gene Name: complement factor B
  Uniprot ID: P00751
  ENSP ID: ENSP00000391902

SEQ ID NO: 19497 - protein, 764 aa, Homo sapiens; identical to SEQ ID NO: 19494
  Payload ID: 3902
  Gene Symbol: CFB
  Gene Name: complement factor B
  Uniprot ID: P00751
  ENSP ID: ENSP00000401719

SEQ ID NO: 19498 - protein, 764 aa, Homo sapiens [sequence omitted]

SEQ ID NO: 19499 - protein, 764 aa, Homo sapiens; identical to SEQ ID NO: 19494
  Payload ID: 3902
  Gene Symbol: CFB
  Gene Name: complement factor B
  Uniprot ID: P00751
  ENSP ID: ENSP00000411515

SEQ ID NO: 19500 - protein, 764 aa, Homo sapiens; identical to SEQ ID NO: 19494
  Payload ID: 3902
  Gene Symbol: CFB
  Gene Name: complement factor B
  Uniprot ID: P00751
  ENSP ID: ENSP00000413351

SEQ ID NO: 19501 - protein, 764 aa, Homo sapiens; identical to SEQ ID NO: 19494
  Payload ID: 3902
  Gene Symbol: CFB
  Gene Name: complement factor B
  Uniprot ID: P00751
  ENSP ID: ENSP00000414341

SEQ ID NO: 19502 - protein, 764 aa, Homo sapiens; identical to SEQ ID NO: 19494
  Payload ID: 3902
  Gene Symbol: CFB
  Gene Name: complement factor B
  Uniprot ID: P00751
  ENSP ID: ENSP00000414889

SEQ ID NO: 19503 - protein, 764 aa, Homo sapiens; identical to SEQ ID NO: 19494
  Payload ID: 3902
  Gene Symbol: CFB
  Gene Name: complement factor B
  Uniprot ID: P00751
  ENSP ID: ENSP00000416561

SEQ ID NO: 19504 - protein, 86 aa, Homo sapiens
  Payload ID: 3902
  Gene Symbol: CFB
  Gene Name: complement factor B
  ENSP ID: ENSP00000417793
MGSNLSPQLCLMPFILGLLSGVRVSFWLLPVPCADTYLQIYGVLEHPEDSRPKDCQEGRVQSNPLSKTTRLRERGILAPVSLLQCE

SEQ ID NO: 19505 - protein, 68 aa, Homo sapiens
  Payload ID: 3902
  Gene Symbol: CFB
  Gene Name: complement factor B
  ENSP ID: ENSP00000418833
  MOD_RES (1)..(1): Any amino acid
XPRFLCTGGVSPYADPNTCRGDSGGPLIVHKRSRFIQVSPPFPIWGDAKWSAWAPKQESSMHVASNSR

SEQ ID NO: 19506 - protein, 305 aa, Homo sapiens
  Payload ID: 3902
  Gene Symbol: CFB
  Gene Name: complement factor B
  ENSP ID: ENSP00000419887
  MOD_RES (1)..(1): Any amino acid
XDGLHNMGGDPITVIDEIRDLLYIGKDRKNPREDYLDVYVFGVGPLVNQVNINALASKKDNEQHVFKVKDMENLEDVFYQMIGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 19507 - protein, 144 aa, Homo sapiens
  Payload ID: 3902
  Gene Symbol: CFB
  Gene Name: complement factor B
  ENSP ID: ENSP00000420090
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRT

SEQ ID NO: 19508 - protein, 253 aa, Homo sapiens
  Payload ID: 3903
  Gene Symbol: CFD
  Gene Name: complement factor D (adipsin)
  Uniprot ID: P00746
  ENSP ID: ENSP00000332139
MHSWERLAVLVLLGAAACAAPPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKGDSGGPLVCGGVLEGVVTSGSRVCGNRKKPGIYTRVASYAAWIDSVLA

SEQ ID NO: 19509 - protein, 260 aa, Homo sapiens
  Payload ID: 3903
  Gene Symbol: CFD
  Gene Name: complement factor D (adipsin)
  ENSP ID: ENSP00000468253
MHSWERLAVLVLLGAAACGEEAWAWAAPPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKGDSGGPLVCGGVLEGVVTSGSRVCGNRKKPGIYTRVASYAAWIDSVLA

SEQ ID NO: 19510 - protein, 253 aa, Homo sapiens; identical to SEQ ID NO: 19508
  Payload ID: 3903
  Gene Symbol: CFD
  Gene Name: complement factor D (adipsin)
  Uniprot ID: P00746
  ENSP ID: ENSP00000478745

SEQ ID NO: 19511 - protein, 260 aa, Homo sapiens; identical to SEQ ID NO: 19509
  Payload ID: 3903
  Gene Symbol: CFD
  Gene Name: complement factor D (adipsin)
  ENSP ID: ENSP00000488580

SEQ ID NO: 19512 - protein, 385 aa, Homo sapiens
  Payload ID: 3904
  Gene Symbol: CFH
  Gene Name: complement factor H
  ENSP ID: ENSP00000352658
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNHGRKFVQGKSIDVACHPGYALPKAQTTVTCMENGWSPTPRCIRVSFTL

SEQ ID NO: 19513 - protein, 1231 aa, Homo sapiens
  Payload ID: 3904
  Gene Symbol: CFH
  Gene Name: complement factor H
  Uniprot ID: P08603
  ENSP ID: ENSP00000356399
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNHGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 19514 - protein, 449 aa, Homo sapiens
  Payload ID: 3904
  Gene Symbol: CFH
  Gene Name: complement factor H
  ENSP ID: ENSP00000487250
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNHGRKFVQGKSIDVACHPGYALPKAQTTVTCMENGWSPTPRCIRVSFTL

SEQ ID NO: 19515 - protein, 330 aa, Homo sapiens
  Payload ID: 3905
  Gene Symbol: CFHR1
  Gene Name: complement factor H-related 1
  Uniprot ID: Q03591
  ENSP ID: ENSP00000314299
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYLRTGESAEFVCKRGYRLSSRSHTLRTTCWDGKLEYPTCAKR

SEQ ID NO: 19516 - protein, 271 aa, Homo sapiens
  Payload ID: 3905
  Gene Symbol: CFHR1
  Gene Name: complement factor H-related 1
  ENSP ID: ENSP00000356394
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDSTGKCGPPPPIDNGDITSFPLSVYAPASSVEYQCQNLYQLEGNKRITCRNGQWSEPPKCLHPCVISREIMENYNIALRWTAKQKLYLRTGESAEFVCKRGYRLSSRSHTLRTTCWDGKLEYPTCAKR

SEQ ID NO: 19517 - protein, 270 aa, Homo sapiens
  Payload ID: 3906
  Gene Symbol: CFHR2
  Gene Name: complement factor H-related 2
  Uniprot ID: P36980
  ENSP ID: ENSP00000356385
MWLLVSVILISRISSVGGEAMFCDFPKINHGILYDEEKYKPFSQVPTGEVFYYSCEYNFVSPSKSFWTRITCAEEGWSPTPKCLRLCFFPFVENGHSESSGQTHLEGDTVQIICNTGYRLQNNENNISCVERGWSTPPKCRSTISAEKCGPPPPIDNGDITSFLLSVYAPGSSVEYQCQNLYQLEGNNQITCRNGQWSEPPKCLDPCVISQEIMEKYNIKLKWTNQQKLYSRTGDIVEFVCKSGYHPTKSHSFRAMCQNGKLVYPSCEEK

SEQ ID NO: 19518 - protein, 254 aa, Homo sapiens
  Payload ID: 3906
  Gene Symbol: CFHR2
  Gene Name: complement factor H-related 2
  ENSP ID: ENSP00000476677
MWLLVSVILISRISSVGGEAMFCDFPKINHGILYDEEKYKPFSQVPTGEVFYYSCEYNFVSPSKSFWTRITCAEEGWSPTPKCLRQTHLEGDTVQIICNTGYRLQNNENNISCVERGWSTPPKCRSTISAEKCGPPPPIDNGDITSFLLSVYAPGSSVEYQCQNLYQLEGNNQITCRNGQWSEPPKCLDPCVISQEIMEKYNIKLKWTNQQKLYSRTGDIVEFVCKSGYHPTKSHSFRAMCQNGKLVYPSCEEK

SEQ ID NO: 19519 - protein, 330 aa, Homo sapiens
  Payload ID: 3907
  Gene Symbol: CFHR3
  Gene Name: complement factor H-related 3
  Uniprot ID: Q02985
  ENSP ID: ENSP00000356395
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSGSITCLQNGWSAQPICINSSEKCGPPPPISNGDTTSFLLKVYVPQSRVEYQCQPYYELQGSNYVTCSNGEWSEPPRCIHPCIITEENMNKNNIKLKGRSDRKYYAKTGDTIEFMCKLGYNANTSILSFQAVCREGIVEYPRCE

SEQ ID NO: 19520 - protein, 232 aa, Homo sapiens
  Payload ID: 3907
  Gene Symbol: CFHR3
  Gene Name: complement factor H-related 3
  ENSP ID: ENSP00000356397
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSGSITCLQNGWSAQPICITACIAFRAHAQKSCTCRGRNECLILNFC

SEQ ID NO: 19521 - protein, 269 aa, Homo sapiens
  Payload ID: 3907
  Gene Symbol: CFHR3
  Gene Name: complement factor H-related 3
  Uniprot ID: Q02985
  ENSP ID: ENSP00000375845
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVNSSEKCGPPPPISNGDTTSFLLKVYVPQSRVEYQCQPYYELQGSNYVTCSNGEWSEPPRCIHPCIITEENMNKNNIKLKGRSDRKYYAKTGDTIEFMCKLGYNANTSILSFQAVCREGIVEYPRCE

SEQ ID NO: 19522 - protein, 232 aa, Homo sapiens; identical to SEQ ID NO: 19520
  Payload ID: 3907
  Gene Symbol: CFHR3
  Gene Name: complement factor H-related 3
  ENSP ID: ENSP00000436258

SEQ ID NO: 19523 - protein, 195 aa, Homo sapiens
  Payload ID: 3907
  Gene Symbol: CFHR3
  Gene Name: complement factor H-related 3
  ENSP ID: ENSP00000481905
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSDMVFCISY

SEQ ID NO: 19524 - protein, 331 aa, Homo sapiens
  Payload ID: 3908
  Gene Symbol: CFHR4
  Gene Name: complement factor H-related 4
  Uniprot ID: Q92496
  ENSP ID: ENSP00000251424
MLLLINVILTLWVSCANGQEVKPCDFPEIQHGGLYYKSLRRLYFPAAAGQSYSYYCDQNFVTPSGSYWDYIHCTQDGWSPTVPCLRTCSKSDIEIENGFISESSSIYILNKEIQYKCKPGYATADGNSSGSITCLQNGWSAQPICIKFCDMPVFENSRAKSNGMRFKLHDTLDYECYDGYEISYGNTTGSIVCGEDGWSHFPTCYNSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 19525 - protein, 577 aa, Homo sapiens
  Payload ID: 3908
  Gene Symbol: CFHR4
  Gene Name: complement factor H-related 4
  Uniprot ID: Q92496
  ENSP ID: ENSP00000356386
MLLLINVILTLWVSCANGQVKPCDFPEIQHGGLYYKSLRRLYFPAAAGQSYSYYCDQNFVTPSGSYWDYIHCTQDGWSPTVPCLRTCSKSDVEIENGFISESSSIYILNEETQYNCKPGYATAEGNSSGSITCLQNGWSTQPICIKFCDMPVFENSRAKSNGMWFKLHDTLDYECYDGYESSYGNTTDSIVCGEDGWSHLPTCYNSSENCGPPPPISNGDTTSFPQKVYLPWSRVEYQCQSYYELQGSKYVTCSNGDWSEPPRCISMKPCEFPEIQHGHLYYENTRRPYFPVATGQSYSYYCDQNFVTPSGSYWDYIHCTQDGWLPTVPCLRTCSKSDIEIENGFISESSSIYILNKEIQYKCKPGYATADGNSSGSITCLQNGWSAQPICIKFCDMPVFENSRAKSNGMRFKLHDTLDYECYDGYEISYGNTTGSIVCGEDGWSHFPTCYNSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 19526 - protein, 331 aa, Homo sapiens
  Payload ID: 3908
  Gene Symbol: CFHR4
  Gene Name: complement factor H-related 4
  ENSP ID: ENSP00000356388
MLLLINVILTLWVSCANGQEVKPCDFPEIQHGGLYYKSLRRLYFPAAAGQSYSYYCDQNFVTPSGSYWDYIHCTQDGWLPTVPCLRTCSKSDIEIENGFISESSSIYILNKEIQYKCKPGYATADGNSSGSITCLQNGWSAQPICIKFCDMPVFENSRAKSNGMRFKLHDTLDYECYDGYEISYGNTTGSIVCGEDGWSHFPTCYNSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 19527 - protein, 201 aa, Homo sapiens
  Payload ID: 3908
  Gene Symbol: CFHR4
  Gene Name: complement factor H-related 4
  ENSP ID: ENSP00000477162
MENGWSPPCRCIRVRTCSKSDIEIENGFISESSSIYILNKEIQYKCKPGYATADGNSSGSITCLQNGWSAQPICINSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 19528 - protein, 569 aa, Homo sapiens
  Payload ID: 3909
  Gene Symbol: CFHR5
  Gene Name: complement factor H-related 5
  Uniprot ID: Q9BXR6
  ENSP ID: ENSP00000256785
MLLLFSVILISWVSTVGGEGTLCDFPKIHHGFLYDEEDYNPFSQVPTGEVFYYSCEYNFVSPSKSFWTRITCTEEGWSPTPKCLRMCSFPFVKNGHSESSGLIHLEGDTVQIICNTGYSLQNNEKNISCVERGWSTPPICSFTKGECHVPILEANVDAQPKKESYKVGDVLKFSCRKNLIRVGSDSVQCYQFGWSPNFPTCKGQVRSCGPPPQLSNGEVKEIRKEEYGHNEVVEYDCNPNFIINGPKKIQCVDGEWTTLPTCVEQVKTCGYIPELEYGYVQPSVPPYQHGVSVEVNCRNEYAMIGNNMITCINGIWTELPMCVATHQLKRCKIAGVNIKTLLKLSGKEFNHNSRIRYRCSDIFRYRHSVCINGKWNPEVDCTEKREQFCPPPPQIPNAQNMTTTVNYQDGEKVAVLCKENYLLPEAKEIVCKDGRWQSLPRCVESTAYCGPPPSINNGDTTSFPLSVYPPGSTVTYRCQSFYKLQGSVTVTCRNKQWSEPPRCLDPCVVSEENMNKNNIQLKWRNDGKLYAKTGDAVEFQCKFPHKAMISSPPFRAICQEGKFEYPICE

SEQ ID NO: 19529 - protein, 270 aa, Homo sapiens; identical to SEQ ID NO: 19517
  Payload ID: 3910
  Gene Symbol:
  Gene Name: Complement factor H-related protein 2  [Source:UniProtKB/Swiss-Prot
  Acc:P36980]
  Uniprot ID: P36980
  ENSP ID: ENSP00000356391

SEQ ID NO: 19530 - protein, 583 aa, Homo sapiens
  Payload ID: 3911
  Gene Symbol: CFI
  Gene Name: complement factor I
  Uniprot ID: P05156
  ENSP ID: ENSP00000378130
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVTQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 19531 - protein, 591 aa, Homo sapiens
  Payload ID: 3911
  Gene Symbol: CFI
  Gene Name: complement factor I
  ENSP ID: ENSP00000378131
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAAARHPTIQGFASVTQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 19532 - protein, 161 aa, Homo sapiens
  Payload ID: 3911
  Gene Symbol: CFI
  Gene Name: complement factor I
  ENSP ID: ENSP00000422009
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQ

SEQ ID NO: 19533 - protein, 576 aa, Homo sapiens
  Payload ID: 3911
  Gene Symbol: CFI
  Gene Name: complement factor I
  ENSP ID: ENSP00000427438
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 19534 - protein, 378 aa, Homo sapiens
  Payload ID: 3911
  Gene Symbol: CFI
  Gene Name: complement factor I
  ENSP ID: ENSP00000483416
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVTQEETEILTADMDAERRRIKSLLPKLSCGVKNRMHIRRKRIVGGKRAQLGGKMKQISLDIFKGLHRVYAILEFCCIILK

SEQ ID NO: 19535 - protein, 469 aa, Homo sapiens
  Payload ID: 3912
  Gene Symbol: CFP
  Gene Name: complement factor properdin
  Uniprot ID: P27918
  ENSP ID: ENSP00000247153
MITEGAQAPRLLLPPLLLLLTLPATGSDPVLCFTQYEESSGKCKGLLGGGVSVEDCCLNTAFAYQKRSGGLCQPCRSPRWSLWSTWAPCSVTCSEGSQLRYRRCVGWNGQCSGKVAPGTLEWQLQACEDQQCCPEMGGWSGWGPWEPCSVTCSKGTRTRRRACNHPAPKCGGHCPGQAQESEACDTQQVCPTHGAWATWGPWTPCSASCHGGPHEPKETRSRKCSAPEPSQKPPGKPCPGLAYEQRRCTGLPPCPVAGGWGPWGPVSPCPVTCGLGQTMEQRTCNHPVPQHGGPFCAGDATRTHICNTAVPCPVDGEWDSWGEWSPCIRRNMKSISCQEIPGQQSRGRTCRGRKFDGHRCAGQQQDIRHCYSIQHCPLKGSWSEWSTWGLCMPPCGPNPTRARQRLCTPLLPKYPPTVSMVEGQGEKNVTFWGRPLPRCEELQGQKLVVEEKRPCLHVPACKDPEEEEL

SEQ ID NO: 19536 - protein, 415 aa, Homo sapiens
  Payload ID: 3912
  Gene Symbol: CFP
  Gene Name: complement factor properdin
  ENSP ID: ENSP00000366204
MITEGAQAPRLLLPPLLLLLTLPATGSDPVLCFTQYEESSGKCKGLLGGGVSVEDCCLNTAFAYQKRSGGLCQPCRSPRWSLWSTWAPCSVTCSEGSQLRYRRCVGWNGQCSGKVAPGTLEWQLQACEDQQCCPEMGGWSGWGPWEPCSVTCSKGTRTRRRACNHPAPKCGGHCPGQAQESEACDTQQVCPTHGAWATWGPWTPCSASCHGGPHEPKETRSRKCSAPEPSQKPPGKPCPGLAYEQRRCTGLPPCPVAGGWGPWGPVSPCPVTCGLGQTMEQRTCNHPVPQHGGPFCAGDATRTHICNTAVPCPVDGEWDSWGEWSPCIRRNMKSISCQEIPGQQSRGRTCRGRKFDGHRCAGQQQDIRHCYSIQHCPLKGSWSEWSTWGLCMPPCGPNPTRARQRLCTPLLPKYP

SEQ ID NO: 19537 - protein, 469 aa, Homo sapiens; identical to SEQ ID NO: 19535
  Payload ID: 3912
  Gene Symbol: CFP
  Gene Name: complement factor properdin
  Uniprot ID: P27918
  ENSP ID: ENSP00000380189

SEQ ID NO: 19538 - protein, 167 aa, Homo sapiens
  Payload ID: 3912
  Gene Symbol: CFP
  Gene Name: complement factor properdin
  ENSP ID: ENSP00000418258
MGGWSGWGPWEPCSVTCSKGTRTRRRACNHPAPKCGGHCPGQAQESEACDTQQVCPTHGAWATWGPWTPCSASCHGGPHEPKETRSRKCSAPEPSQKPPGKPCPGLAYEQRRCTGLPPCPVAGGWGPWGPVSPCPVTCGLGQTMEQRTCNHPVPQHGGPFCAGDATR

SEQ ID NO: 19539 - protein, 134 aa, Homo sapiens
  Payload ID: 3913
  Gene Symbol: CPLX1
  Gene Name: complexin 1
  Uniprot ID: O14810
  ENSP ID: ENSP00000305613
MEFVMKQALGGATKDMGKMLGGDEEKDPDAAKKEEERQEALRQAEEERKAKYAKMEAEREAVRQGIRDKYGIKKKEEREAEAQAAMEANSEGSLTRPKKAIPPGCGDEVEEEDESILDTVIKYLPGPLQDMLKK

SEQ ID NO: 19540 - protein, 110 aa, Homo sapiens
  Payload ID: 3913
  Gene Symbol: CPLX1
  Gene Name: complexin 1
  ENSP ID: ENSP00000421947
MGKMLGGDEEKDPDAAKKEEERQEALRQAEEERKAKYAKMEAEREAVRQGIRDKYGIKKKEEREAEAQAAMEANSEGSLTRPKKAIPPGCGDEVEEEDESILDTVIKYLP

SEQ ID NO: 19541 - protein, 113 aa, Homo sapiens
  Payload ID: 3913
  Gene Symbol: CPLX1
  Gene Name: complexin 1
  ENSP ID: ENSP00000425960
MEFVMKQALGGATKDMGKMLGGDEEKDPDAAKKEEERQEALRQGIRDKYGIKKKEEREAEAQAAMEANSEGSLTRPKKAIPPGCGDEVEEEDESILDTVIKYLPGPLQDMLKK

SEQ ID NO: 19542 - protein, 134 aa, Homo sapiens
  Payload ID: 3914
  Gene Symbol: CPLX2
  Gene Name: complexin 2
  Uniprot ID: Q6PUV4
  ENSP ID: ENSP00000352544
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPKKAIPAGCGDEEEEEEESILDTVLKYLPGPLQDMFKK

SEQ ID NO: 19543 - protein, 134 aa, Homo sapiens; identical to SEQ ID NO: 19542
  Payload ID: 3914
  Gene Symbol: CPLX2
  Gene Name: complexin 2
  Uniprot ID: Q6PUV4
  ENSP ID: ENSP00000377346

SEQ ID NO: 19544 - protein, 111 aa, Homo sapiens
  Payload ID: 3914
  Gene Symbol: CPLX2
  Gene Name: complexin 2
  ENSP ID: ENSP00000421106
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPKKAIPAGCGDEEEE

SEQ ID NO: 19545 - protein, 134 aa, Homo sapiens; identical to SEQ ID NO: 19542
  Payload ID: 3914
  Gene Symbol: CPLX2
  Gene Name: complexin 2
  Uniprot ID: Q6PUV4
  ENSP ID: ENSP00000421825

SEQ ID NO: 19546 - protein, 6 aa, Homo sapiens
  Payload ID: 3914
  Gene Symbol: CPLX2
  Gene Name: complexin 2
  ENSP ID: ENSP00000423564
MDFVMK

SEQ ID NO: 19547 - protein, 119 aa, Homo sapiens
  Payload ID: 3914
  Gene Symbol: CPLX2
  Gene Name: complexin 2
  ENSP ID: ENSP00000423612
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPKKAIPAGCGDEEEEEEESILDT

SEQ ID NO: 19548 - protein, 77 aa, Homo sapiens
  Payload ID: 3914
  Gene Symbol: CPLX2
  Gene Name: complexin 2
  ENSP ID: ENSP00000424305
MDFVMKQALGGATKDMGKMLGGEEEKDPDAQKKEEERQEALRQQEEERKAKHARMEAEREKVRQQIRDKYGLKKKEE

SEQ ID NO: 19549 - protein, 37 aa, Homo sapiens
  Payload ID: 3914
  Gene Symbol: CPLX2
  Gene Name: complexin 2
  ENSP ID: ENSP00000425284
MDFVMKQALGGATKDMGKMLGGEEEKDPDAQKKEEER

SEQ ID NO: 19550 - protein, 70 aa, Homo sapiens
  Payload ID: 3914
  Gene Symbol: CPLX2
  Gene Name: complexin 2
  ENSP ID: ENSP00000425973
MDFVMKQALGGATKDMGKMLGGEEEKDPDAQKKEEERQEALRQQEEERKAKHARMEAEREKVRQQIRDKD

SEQ ID NO: 19551 - protein, 158 aa, Homo sapiens
  Payload ID: 3915
  Gene Symbol: CPLX3
  Gene Name: complexin 3
  Uniprot ID: Q8WVH0
  ENSP ID: ENSP00000378464
MAFMVKTMVGGQLKNLTGSLGGGEDKGDGDKSAAEAQGMSREEYEEYQKQLVEEKMERDAQFTQRKAERATLRSHFRDKYRLPKNETDESQIQMAGGDVELPRELAKMIEEDTEEEEEKASVLGQLASLPGLNLGSLKDKAQATLGDLKQSAEKCHVM

SEQ ID NO: 19552 - protein, 160 aa, Homo sapiens
  Payload ID: 3916
  Gene Symbol: CPLX4
  Gene Name: complexin 4
  Uniprot ID: Q7Z7G2
  ENSP ID: ENSP00000299721
MAFLMKSMISNQVKNLGFGGGSEENKEEGGASDPAAAQGMTREEYEEYQKQMIEEKMERDAAFTQKKAERACLRVHLREKYRLPKSEMDENQIQMAGDDVDLPEDLRKMVDEDQEEEEDKDSILGQIQNLQNMDLDTIKEKAQATFTEIKQTAEQKCSVM

SEQ ID NO: 19553 - protein, 97 aa, Homo sapiens
  Payload ID: 3916
  Gene Symbol: CPLX4
  Gene Name: complexin 4
  ENSP ID: ENSP00000466304
MAFLMKSMISNQVKNLGFGGGSEENKEEGGASDPAAAQGMTREEYEEYQKQMIEEKMERDAAFTQKKAERACLRVHLREKYRLPKCTGICMSPPCCR

SEQ ID NO: 19554 - protein, 980 aa, Homo sapiens
  Payload ID: 3917
  Gene Symbol: COG1
  Gene Name: component of oligomeric golgi complex 1
  Uniprot ID: Q8WTW3
  ENSP ID: ENSP00000299886
MATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIRDAMWELLTNESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQVVPPARSTAGDPTVPGSLFRQLVSEEDNTSAPSLFKLGWLSSMTK

SEQ ID NO: 19555 - protein, 962 aa, Homo sapiens
  Payload ID: 3917
  Gene Symbol: COG1
  Gene Name: component of oligomeric golgi complex 1
  ENSP ID: ENSP00000400111
  MOD_RES (1)..(1): Any amino acid
XATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIRDAMWELLTNESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQVGAKSKRLIRGWVPTSHRATHDQLPFK

SEQ ID NO: 19556 - protein, 124 aa, Homo sapiens
  Payload ID: 3917
  Gene Symbol: COG1
  Gene Name: component of oligomeric golgi complex 1
  ENSP ID: ENSP00000462101
  MOD_RES (1)..(1): Any amino acid
XALKRLDLRDPAALFETHGAEEIRGLERQVRAEIEHKKEELRQMVGERYRDLIEAADTIGQMRRCAVGLVDAVKATDQYCARLRQAGSAAPRPPRAQQFCAFPCSHSSHPRRSSTAWLPRSSYS

SEQ ID NO: 19557 - protein, 26 aa, Homo sapiens
  Payload ID: 3917
  Gene Symbol: COG1
  Gene Name: component of oligomeric golgi complex 1
  ENSP ID: ENSP00000462709
QLAPRSSTFNSQEPHNILPLASSQIR

SEQ ID NO: 19558 - protein, 102 aa, Homo sapiens
  Payload ID: 3917
  Gene Symbol: COG1
  Gene Name: component of oligomeric golgi complex 1
  ENSP ID: ENSP00000463298
  MOD_RES (1)..(1): Any amino acid
XKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQYDANC

SEQ ID NO: 19559 - protein, 126 aa, Homo sapiens
  Payload ID: 3917
  Gene Symbol: COG1
  Gene Name: component of oligomeric golgi complex 1
  ENSP ID: ENSP00000463696
  MOD_RES (1)..(1): Any amino acid
XLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQYDANC

SEQ ID NO: 19560 - protein, 940 aa, Homo sapiens
  Payload ID: 3917
  Gene Symbol: COG1
  Gene Name: component of oligomeric golgi complex 1
  ENSP ID: ENSP00000479450
MATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIRDAMWELLTNESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQYDANC

SEQ ID NO: 19561 - protein, 737 aa, Homo sapiens
  Payload ID: 3918
  Gene Symbol: COG2
  Gene Name: component of oligomeric golgi complex 2
  Uniprot ID: Q14746
  ENSP ID: ENSP00000355628
MEKSRMNLPKGPDTLCFDKDEFMKEDFDVDHFVSDCRKRVQLEELRDDLELYYKLLKTAMVELINKDYADFVNLSTNLVGMDKALNQLSVPLGQLREEVLSLRSSVSEGIRAVDERMSKQEDIRKKKMCVLRLIQVIRSVEKIEKILNSQSSKETSALEASSPLLTGQILERIATEFNQLQFHAVQSKGMPLLDKVRPRIAGITAMLQQSLEGLLLEGLQTSDVDIIRHCLRTYATIDKTRDAEALVGQVLVKPYIDEVIIEQFVESHPNGLQVMYNKLLEFVPHHCRLLREVTGGAISSEKGNTVPGYDFLVNSVWPQIVQGLEEKLPSLFNPGNPDAFHEKYTISMDFVRRLERQCGSQASVKRLRAHPAYHSFNKKWNLPVYFQIRFREIAGSLEAALTDVLEDAPAESPYCLLASHRTWSSLRRCWSDEMFLPLLVHRLWRLTLQILARYSVFVNELSLRPISNESPKEIKKPLVTGSKEPSITQGNTEDQGSGPSETKPVVSISRTQLVYVVADLDKLQEQLPELLEIIKPKLEMIGFKNFSSISALEDSQSSFSACVPSLSSKIIQDLSDSCFGFLKSALEVPRLYRRTNKEVPTTASSYVDSALKPLFQLQSGHKDKLKQAIIQQWLEGTLSESTHKYYETVSDVLNSVKKMEESLKRLKQARKTTPANPVGPSGGMSDDDKIRLQLALDVEYLGEQIQKLGLQASDIKSFSALAELVAAAKDQATAEQP

SEQ ID NO: 19562 - protein, 738 aa, Homo sapiens
  Payload ID: 3918
  Gene Symbol: COG2
  Gene Name: component of oligomeric golgi complex 2
  Uniprot ID: Q14746
  ENSP ID: ENSP00000355629
MEKSRMNLPKGPDTLCFDKDEFMKEDFDVDHFVSDCRKRVQLEELRDDLELYYKLLKTAMVELINKDYADFVNLSTNLVGMDKALNQLSVPLGQLREEVLSLRSSVSEGIRAVDERMSKQEDIRKKKMCVLRLIQVIRSVEKIEKILNSQSSKETSALEASSPLLTGQILERIATEFNQLQFHAVQSKGMPLLDKVRPRIAGITAMLQQSLEGLLLEGLQTSDVDIIRHCLRTYATIDKTRDAEALVGQVLVKPYIDEVIIEQFVESHPNGLQVMYNKLLEFVPHHCRLLREVTGGAISSEKGNTVPGYDFLVNSVWPQIVQGLEEKLPSLFNPGNPDAFHEKYTISMDFVRRLERQCGSQASVKRLRAHPAYHSFNKKWNLPVYFQIRFREIAGSLEAALTDVLEDAPAESPYCLLASHRTWSSLRRCWSDEMFLPLLVHRLWRLTLQILARYSVFVNELSLRPISNESPKEIKKPLVTGSKEPSITQGNTEDQGSGPSETKPVVSISRTQLVYVVADLDKLQEQLPELLEIIKPKLEMIGFKNFSSISAALEDSQSSFSACVPSLSSKIIQDLSDSCFGFLKSALEVPRLYRRTNKEVPTTASSYVDSALKPLFQLQSGHKDKLKQAIIQQWLEGTLSESTHKYYETVSDVLNSVKKMEESLKRLKQARKTTPANPVGPSGGMSDDDKIRLQLALDVEYLGEQIQKLGLQASDIKSFSALAELVAAAKDQATAEQP

SEQ ID NO: 19563 - protein, 679 aa, Homo sapiens
  Payload ID: 3918
  Gene Symbol: COG2
  Gene Name: component of oligomeric golgi complex 2
  ENSP ID: ENSP00000440349
MVELINKDYADFVNLSTNLVGMDKALNQLSVPLGQLREEVLSLRSSVSEGIRAVDERMSKQEDIRKKKMCVLRLIQVIRSVEKIEKILNSQSSKETSALEASSPLLTGQILERIATEFNQLQFHAVQSKGMPLLDKVRPRIAGITAMLQQSLEGLLLEGLQTSDVDIIRHCLRTYATIDKTRDAEALVGQVLVKPYIDEVIIEQFVESHPNGLQVMYNKLLEFVPHHCRLLREVTGGAISSEKGNTVPGYDFLVNSVWPQIVQGLEEKLPSLFNPGNPDAFHEKYTISMDFVRRLERQCGSQASVKRLRAHPAYHSFNKKWNLPVYFQIRFREIAGSLEAALTDVLEDAPAESPYCLLASHRTWSSLRRCWSDEMFLPLLVHRLWRLTLQILARYSVFVNELSLRPISNESPKEIKKPLVTGSKEPSITQGNTEDQGSGPSETKPVVSISRTQLVYVVADLDKLQEQLPELLEIIKPKLEMIGFKNFSSISAALEDSQSSFSACVPSLSSKIIQDLSDSCFGFLKSALEVPRLYRRTNKEVPTTASSYVDSALKPLFQLQSGHKDKLKQAIIQQWLEGTLSESTHKYYETVSDVLNSVKKMEESLKRLKQARKTTPANPVGPSGGMSDDDKIRLQLALDVEYLGEQIQKLGLQASDIKSFSALAELVAAAKDQATAEQP

SEQ ID NO: 19564 - protein, 124 aa, Homo sapiens
  Payload ID: 3918
  Gene Symbol: COG2
  Gene Name: component of oligomeric golgi complex 2
  ENSP ID: ENSP00000476305
MEKSRMNLPKGPDTLCFDKDEFMKEDFDVDHFVSDCRKRVQLEELRDDLELYYKLLKTAMVELINKDYADFVNLSTNLVGMDKALNQLSVPLGQLREEVLIMSAVSWDSPCLSHWRQGLHPDEQ

SEQ ID NO: 19565 - protein, 828 aa, Homo sapiens
  Payload ID: 3919
  Gene Symbol: COG3
  Gene Name: component of oligomeric golgi complex 3
  Uniprot ID: Q96JB2
  ENSP ID: ENSP00000258654
MAEAALLLLPEAAAERDAREKLALWDRRPDTTAPLTDRQTDSVLELKAAAENLPVPAELPIEDLCSLTSQSLPIELTSVVPESTEDILLKGFTSLGMEEERIETAQQFFSWFAKLQTQMDQDEGTKYRQMRDYLSGFQEQCDAILNDVNSALQHLESLQKQYLFVSNKTGTLHEACEQLLKEQSELVDLAENIQQKLSYFNELETINTKLNSPTLSVNSDGFIPMLAKLDDCITYISSHPNFKDYPIYLLKFKQCLSKALHLMKTYTVNTLQTLTSQLLKRDPSSVPNADNAFTLFYVKFRAAAPKVRTLIEQIELRSEKIPEYQQLLNDIHQCYLDQRELLLGPSIACTVAELTSQNNRDHCALVRSGCAFMVHVCQDEHQLYNEFFTKPTSKLDELLEKLCVSLYDVFRPLIIHVIHLETLSELCGILKNEVLEDHVQNNAEQLGAFAAGVKQMLEDVQERLVYRTHIYIQTDITGYKPAPGDLAYPDKLVMMEQIAQSLKDEQKKVPSEASFSDVHLEEGESNSLTKSGSTESLNPRPQTTISPADLHGMWYPTVRRTLVCLSKLYRCIDRAVFQGLSQEALSACIQSLLGASESISKNKTQIDGQLFLIKHLLILREQIAPFHTEFTIKEISLDLKKTRDAAFKILNPMTVPRFFRLNSNNALIEFLLEGTPEIREHYLDSKKDVDRHLKSACEQFIQQQTKLFVEQLEEFMTKVSALKTMASQGGPKYTLSQQPWAQPAKVNDLAATAYKTIKTKLPVTLRSMSLYLSNKDTEFILFKPVRNNIQQVFQKFHALLKEEFSPEDIQIIACPSMEQLSLLLLVSK

SEQ ID NO: 19566 - protein, 68 aa, Homo sapiens
  Payload ID: 3919
  Gene Symbol: COG3
  Gene Name: component of oligomeric golgi complex 3
  ENSP ID: ENSP00000477882
  MOD_RES (1)..(1): Any amino acid
XIDGQLFLIKHLLILREQIAPFHTEFTIKEISLDLKKTRGFSVKNNGQSGRPQVYSLTAALGTTSKGQ

SEQ ID NO: 19567 - protein, 444 aa, Homo sapiens
  Payload ID: 3919
  Gene Symbol: COG3
  Gene Name: component of oligomeric golgi complex 3
  Uniprot ID: Q96JB2
  ENSP ID: ENSP00000481332
MAEAALLLLPEAAAERDAREKLALWDRRPDTTAPLTDRQTDSVLELKAAAENLPVPAELPIEDLCSLTSQSLPIELTSVVPESTEDILLKGFTSLGMEEERIETAQQFFSWFAKLQTQMDQDEGTKYRQMRDYLSGFQEQCDAILNDVNSALQHLESLQKQYLFVSNKTGTLHEACEQLLKEQSELVDLAENIQQKLSYFNELETINTKLNSPTLSVNSDGFIPMLAKLDDCITYISSHPNFKDYPIYLLKFKQCLSKALHLMKTYTVNTLQTLTSQLLKRDPSSVPNADNAFTLFYVKFRAAAPKVRTLIEQIELRSEKIPEYQQLLNDIHQCYLDQRELLLGPSIACTVAELTSQNNRDHCALVRSGCAFMVHVCQDEHQLYNEFFTKPTSKLDELLEKLCVSLYDVFRPLIIHVIHLETLSELCGILKNEVLEDHVQNNGK

SEQ ID NO: 19568 - protein, 85 aa, Homo sapiens
  Payload ID: 3919
  Gene Symbol: COG3
  Gene Name: component of oligomeric golgi complex 3
  ENSP ID: ENSP00000482221
PEAAAERDAREKLALWDRRPDTTAPLTDRQTDSVLELKAAAENLPVPAEDMVPEVDLKSMKAQVEISLAQLSNSFIPWIIKVVCS

SEQ ID NO: 19569 - protein, 789 aa, Homo sapiens
  Payload ID: 3920
  Gene Symbol: COG4
  Gene Name: component of oligomeric golgi complex 4
  ENSP ID: ENSP00000315775
MGTKMADLDSPPKLSGVQQPSEGVGGGRCSEISAELIRSLTELQELEAVYERLCGEEKVVERELDALLEQQNTIESKMVTLHRMGPNLQLIEGDAKQLAGMITFTCNLAENVSSKVRQLDLAKNRLYQAIQRADDILDLKFCMDGVQTALRSEDYEQAAAHTHRYLCLDKSVIELSRQGKEGSMIDANLKLLQEAEQRLKAIVAEKFAIATKEGDLPQVERFFKIFPLLGLHEEGLRKFSEYLCKQVASKAEENLLMVLGTDMSDRRAAVIFADTLTLLFEGIARIVETHQPIVETYYGPGRLYTLIKYLQVECDRQVEKVVDKFIKQRDYHQQFRHVQNNLMRNSTTEKIEPRELDPILTEVTLMNARSELYLRFLKKRISSDFEVGDSMASEEVKQEHQKCLDKLLNNCLLSCTMQELIGLYVTMEEYFMRETVNKAVALDTYEKGQLTSSMVDDVFYIVKKCIGRALSSSSIDCLCAMINLATTELESDFRDVLCNKLRMGFPATTFQDIQRGVTSAVNIMHSSLQQGKFDTKGIESTDEAKMSFLVTLNNVEVCSENISTLKKTLESDCTKLFSQGIGGEQAQAKFDSCLSDLAAVSNKFRDLLQEGLTELNSTAIKPQVQPWINSFFSVSHNIEEEEFNDYEANDPWVQQFILNLEQQMAEFKASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 19570 - protein, 768 aa, Homo sapiens
  Payload ID: 3920
  Gene Symbol: COG4
  Gene Name: component of oligomeric golgi complex 4
  ENSP ID: ENSP00000377236
MGTKMADLDSPPKLSGVQQPSEGVGGGRCSEISAELIRSLTELQELEAVYERLCGEEKVVERELDALLEQQNTIESKMVTLHRMGPNLQLIEGDAKQLAGMITFTCNLAENVSSKVRQLDLAKNRLYQAIQRADDILDLKFCMDGVQTALRSEDYEQAAAHTHRYLCLDKSVIELSRQGKEGSMIDANLKLLQEAEQRLKAIVAEKFAIATKEGDLPQVERFFKIFPLLGLHEEGLRKFSEYLCKQVASKAEENLLMVLGTDMSDRRAAVIFADTLTLLFEGIARIVETHQPIVETYYGPGRLYTLIKYLQVECDRQVEKVVDKFIKQRDYHQQFRHVQNNLMRNSTTEKIEPRELDPILTEVTLMNARSELYLRFLKKRISSDFEVGDSMASEEVKQEHQKCLDKLLNNCLLSCTMQELIGLYVTMEEYFMRETVNKAVALDTYEKGQLTSSMVDDVFYIVKKCIGRALSSSSIDCLCAMINLATTELESDFRDVLCNKLRMGFPATTFQDIQRGVTSAVNIMHSSLQQGKFDTKGIESTDEAKMSFLSDCTKLFSQGIGGEQAQAKFDSCLSDLAAVSNKFRDLLQEGLTELNSTAIKPQVQPWINSFFSVSHNIEEEEFNDYEANDPWVQQFILNLEQQMAEFKASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 19571 - protein, 337 aa, Homo sapiens
  Payload ID: 3920
  Gene Symbol: COG4
  Gene Name: component of oligomeric golgi complex 4
  Uniprot ID: Q9H9E3
  ENSP ID: ENSP00000432802
MADLDSPPKLSGVQQPSEGVGGGRCSEISAELIRSLTELQELEAVYERLCGEEKVVERELDALLEQQNTIESKMVTLHRMGPNLQLIEGDAKQLAGMITFTCNLAENVSSKVRQLDLAKNRLYQAIQRADDILDLKFCMDGVQTALRSEDYEQAAAHTHRYLCLDKSVIELSRQGKEGSMIDANLKLLQEAEQRLKAIVAEKFAIATKEGDLPQVERFFKIFPLLGLHEEGLRKFSEYLCKQVASKAEENLLMVLGTDMSDRRAAVIFADTLTLLFEGIARIVETHQPIVETYYGPGRLYTLIKYLQVECDRQVEKVVDKFIKQRDYHQQNFVFSFF

SEQ ID NO: 19572 - protein, 100 aa, Homo sapiens
  Payload ID: 3920
  Gene Symbol: COG4
  Gene Name: component of oligomeric golgi complex 4
  ENSP ID: ENSP00000434160
MGTKMADLDSPPKLSGVQQPSEGVGGGRCSEISAELIRSLTELQELEAVYERLCGEEKVVERELDALLEQQNTIESKMVTLHRMGTASIRPFRELMTSWT

SEQ ID NO: 19573 - protein, 193 aa, Homo sapiens
  Payload ID: 3920
  Gene Symbol: COG4
  Gene Name: component of oligomeric golgi complex 4
  ENSP ID: ENSP00000454573
MGTKMADLDSPPKLSGVQQPSEGVGGGRCSEISAELIRSLTELQELEAVYERLCGEEKVVERELDALLEQQNTIESKMVTLHRMGPNLQLIEGDAKQLAGMITFTCNLAENVSSKVRQLDLAKNRLYQAIQRADDILDLKFCMDGVQTALRSEDYEQAAAHTHRYLCLDKSVICPRWSASSRSSHCWVCMRRD

SEQ ID NO: 19574 - protein, 143 aa, Homo sapiens
  Payload ID: 3920
  Gene Symbol: COG4
  Gene Name: component of oligomeric golgi complex 4
  ENSP ID: ENSP00000455693
AIKPQVQPWINSFFSVSHNIEEASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 19575 - protein, 130 aa, Homo sapiens
  Payload ID: 3920
  Gene Symbol: COG4
  Gene Name: component of oligomeric golgi complex 4
  ENSP ID: ENSP00000456653
MGTKMADLDSPPKLSGVQQPSEGVGGGRCSEISAELIRSLTELQELEAVYERLCGEEKVVERELDALLEQQNTIESKMVTLHRMGPNLQLIEGDAKQLAGMITFTCNLAENVSSKVRQLDLAKKHSTNLE

SEQ ID NO: 19576 - protein, 157 aa, Homo sapiens
  Payload ID: 3920
  Gene Symbol: COG4
  Gene Name: component of oligomeric golgi complex 4
  ENSP ID: ENSP00000461912
MVTLHRMGPNLQLIEGDAKQLAGMITFTCNLAENVSSKVRQLDLAKNRLYQAIQRADDILDLKFCMDGVQTALRSEDYEQAAAHTHRYLCLDKSVIELSRQGKEGSMIDANLKLLQEAEQRLKAIVAEKFAIATKEGDLPQVERFFKIFPLLGLHEE

SEQ ID NO: 19577 - protein, 72 aa, Homo sapiens
  Payload ID: 3920
  Gene Symbol: COG4
  Gene Name: component of oligomeric golgi complex 4
  ENSP ID: ENSP00000463732
  MOD_RES (1)..(1): Any amino acid
XSPPKLSGVQQPSEGVGGGRCSEISAELIRSLTELQELEAVYERLCGEEKVVERELDALLEQQNTIEILICS

SEQ ID NO: 19578 - protein, 860 aa, Homo sapiens
  Payload ID: 3921
  Gene Symbol: COG5
  Gene Name: component of oligomeric golgi complex 5
  Uniprot ID: Q9UP83
  ENSP ID: ENSP00000297135
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASFWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKVVSSQSSFPLAAEQTIISALKAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIRGALEAYVQSVRSREGKEFAPVYPIMVQLLQKAMSALQ

SEQ ID NO: 19579 - protein, 839 aa, Homo sapiens
  Payload ID: 3921
  Gene Symbol: COG5
  Gene Name: component of oligomeric golgi complex 5
  Uniprot ID: Q9UP83
  ENSP ID: ENSP00000334703
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASFWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIRGALEAYVQSVRSREGKEFAPVYPIMVQLLQKAMSALQ

SEQ ID NO: 19580 - protein, 823 aa, Homo sapiens
  Payload ID: 3921
  Gene Symbol: COG5
  Gene Name: component of oligomeric golgi complex 5
  Uniprot ID: Q9UP83
  ENSP ID: ENSP00000377228
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASFWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKVVSSQSSFPLAAEQTIISALKAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIR

SEQ ID NO: 19581 - protein, 179 aa, Homo sapiens
  Payload ID: 3921
  Gene Symbol: COG5
  Gene Name: component of oligomeric golgi complex 5
  ENSP ID: ENSP00000476238
MEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNEL

SEQ ID NO: 19582 - protein, 75 aa, Homo sapiens
  Payload ID: 3922
  Gene Symbol: COG6
  Gene Name: component of oligomeric golgi complex 6
  Uniprot ID: Q9Y2V7
  ENSP ID: ENSP00000348983
MAEGSGEVVAVSATGAANGLNNGAGGTSATTCNPLSRKLHKILETRLDNDKELGILLLSFSWLLFEDSVRDSRRC

SEQ ID NO: 19583 - protein, 657 aa, Homo sapiens
  Payload ID: 3922
  Gene Symbol: COG6
  Gene Name: component of oligomeric golgi complex 6
  Uniprot ID: Q9Y2V7
  ENSP ID: ENSP00000397441
MAEGSGEVVAVSATGAANGLNNGAGGTSATTCNPLSRKLHKILETRLDNDKEMLEALKALSTFFVENSLRTRRNLRGDIERKSLAINEEFVSIFKEVKEELESISEDVQAMSNCCQDMTSRLQAAKEQTQDLIVKTTKLQSESQKLEIRAQVADAFLSKFQLTSDEMSLLRGTREGPITEDFFKALGRVKQIHNDVKVLLRTNQQTAGLEIMEQMALLQETAYERLYRWAQSECRTLTQESCDVSPVLTQAMEALQDRPVLYKYTLDEFGTARRSTVVRGFIDALTRGGPGGTPRPIEMHSHDPLRYVGDMLAWLHQATASEKEHLEALLKHVTTQGVEENIQEVVGHITEGVCRPLKVRIEQVIVAEPGAVLLYKISNLLKFYHHTISGIVGNSATALLTTIEEMHLLSKKIFFNSLSLHASKLMDKVELPPPDLGPSSALNQTLMLLREVLASHDSSVVPLDARQADFVQVLSCVLDPLLQMCTVSASNLGTADMATFMVNSLYMMKTTLALFEFTDRRLEMLQFQIEAHLDTLINEQASYVLTRVGLSYIYNTVQQHKPEQGSLANMPNLDSVTLKAAMVQFDRYLSAPDNLLIPQLNFLLSATVKEQIVKQSTELVCRAYGEVYAAVMNPINEYKDPENILHRSPQQVQTLLS

SEQ ID NO: 19584 - protein, 615 aa, Homo sapiens
  Payload ID: 3922
  Gene Symbol: COG6
  Gene Name: component of oligomeric golgi complex 6
  Uniprot ID: Q9Y2V7
  ENSP ID: ENSP00000403733
MAEGSGEVVAVSATGAANGLNNGAGGTSATTCNPLSRKLHKILETRLDNDKEMLEALKALSTFFVENSLRTRRNLRGDIERKSLAINEEFVSIFKEVKEELESISEDVQAMSNCCQDMTSRLQAAKEQTQDLIVKTTKLQSESQKLEIRAQVADAFLSKFQLTSDEMSLLRGTREGPITEDFFKALGRVKQIHNDVKVLLRTNQQTAGLEIMEQMALLQETAYERLYRWAQSECRTLTQESCDVSPVLTQAMEALQDRPVLYKYTLDEFGTARRSTVVRGFIDALTRGGPGGTPRPIEMHSHDPLRYVGDMLAWLHQATASEKEHLEALLKHVTTQGVEENIQEVVGHITEGVCRPLKVRIEQVIVAEPGAVLLYKISNLLKFYHHTISGIVGNSATALLTTIEEMHLLSKKIFFNSLSLHASKLMDKVELPPPDLGPSSALNQTLMLLREVLASHDSSVVPLDARQADFVQVLSCVLDPLLQMCTVSASNLGTADMATFMVNSLYMMKTTLALFEFTDRRLEMLQFQIEAHLDTLINEQASYVLTRVGLSYIYNTVQQHKPEQGSLANMPNLDSVTLKAAMVQFDRYLSAPDNLLIPQLNFLLSATVKRPPNGP

SEQ ID NO: 19585 - protein, 61 aa, Homo sapiens
  Payload ID: 3922
  Gene Symbol: COG6
  Gene Name: component of oligomeric golgi complex 6
  ENSP ID: ENSP00000440438
MAEGSGEVVAVSATGAANGLNNGAGGTSATTCNPLSRKLHKILETRLDNDKVPSRLSGWDW

SEQ ID NO: 19586 - protein, 62 aa, Homo sapiens
  Payload ID: 3922
  Gene Symbol: COG6
  Gene Name: component of oligomeric golgi complex 6
  ENSP ID: ENSP00000440473
MAEGSGEVVAVSATGAANGLNNGAGGTSATTCNPLSRKLHKILETRLDNDKSADSKKFTWRY

SEQ ID NO: 19587 - protein, 61 aa, Homo sapiens; identical to SEQ ID NO: 19585
  Payload ID: 3922
  Gene Symbol: COG6
  Gene Name: component of oligomeric golgi complex 6
  ENSP ID: ENSP00000441297

SEQ ID NO: 19588 - protein, 134 aa, Homo sapiens
  Payload ID: 3922
  Gene Symbol: COG6
  Gene Name: component of oligomeric golgi complex 6
  ENSP ID: ENSP00000445217
  MOD_RES (1)..(1): Any amino acid
XFFVENSLRTRRNLRGDIERKSLAINEEFVSIFKEVKEELESISEDVQAMSNCCQDMTSRLQAAKEQTQDLIVKTTKLQSESQKLEIRAQVADAFLSKFQLTSDEMSLLRGTREGPITEFRNYGTDGLTSRNGL

SEQ ID NO: 19589 - protein, 61 aa, Homo sapiens; identical to SEQ ID NO: 19585
  Payload ID: 3922
  Gene Symbol: COG6
  Gene Name: component of oligomeric golgi complex 6
  ENSP ID: ENSP00000486051

SEQ ID NO: 19590 - protein, 770 aa, Homo sapiens
  Payload ID: 3923
  Gene Symbol: COG7
  Gene Name: component of oligomeric golgi complex 7
  Uniprot ID: P83436
  ENSP ID: ENSP00000305442
MDFSKFLADDFDVKEWINAAFRAGSKEAASGKADGHAATLVMKLQLFIQEVNHAVEETSHQALQNMPKVLRDVEALKQEASFLKEQMILVKEDIKKFEQDTSQSMQVLVEIDQVKSRMQLAAESLQEADKWSTLSADIEETFKTQDIAVISAKLTGMQNSLMMLVDTPDYSEKCVHLEALKNRLEALASPQIVAAFTSQAVDQSKVFVKVFTEIDRMPQLLAYYYKCHKVQLLAAWQELCQSDLSLDRQLTGLYDALLGAWHTQIQWATQVFQKPHEVVMVLLIQTLGALMPSLPSCLSNGVERAGPEQELTRLLEFYDATAHFAKGLEMALLPHLHEHNLVKVTELVDAVYDPYKPYQLKYGDMEESNLLIQMSAVPLEHGEVIDCVQELSHSVNKLFGLASAAVDRCVRFTNGLGTCGLLSALKSLFAKYVSDFTSTLQSIRKKCKLDHIPPNSLFQEDWTAFQNSIRIIATCGELLRHCGDFEQQLANRILSTAGKYLSDSCSPRSLAGFQESILTDKKNSAKNPWQEYNYLQKDNPAEYASLMEILYTLKEKGSSNHNLLAAPRAALTRLNQQAHQLAFDSVFLRIKQQLLLISKMDSWNTAGIGETLTDELPAFSLTPLEYISNIGQYIMSLPLNLEPFVTQEDSALELALHAGKLPFPPEQGDELPELDNMADNWLGSIARATMQTYCDAILQIPELSPHSAKQLATDIDYLINVMDALGLQPSRTLQHIVTLLKTRPEDYRQVSKGLPRRLATTVATMRSVNY

SEQ ID NO: 19591 - protein, 88 aa, Homo sapiens
  Payload ID: 3923
  Gene Symbol: COG7
  Gene Name: component of oligomeric golgi complex 7
  ENSP ID: ENSP00000459872
  MOD_RES (1)..(1): Any amino acid
XNLEPFVTQEDSALELALHAGKLPFPPEQGDELPELDNMADNWLGSIARATMQTYCDAILQIPELSPHSAKQLATDIGSPGPAPEILT

SEQ ID NO: 19592 - protein, 113 aa, Homo sapiens
  Payload ID: 3923
  Gene Symbol: COG7
  Gene Name: component of oligomeric golgi complex 7
  ENSP ID: ENSP00000460151
  MOD_RES (1)..(1): Any amino acid
XDSALELALHAGKLPFPPEQGDELPELDNMADNWLGSIARATMQTYCDAILQIPELSPHSAKQLATDIGGSPQDRRWEGQLLPAASVSFSFALQESHPKSSLSFSCGFGSEAG

SEQ ID NO: 19593 - protein, 612 aa, Homo sapiens
  Payload ID: 3924
  Gene Symbol: COG8
  Gene Name: component of oligomeric golgi complex 8
  Uniprot ID: Q96MW5
  ENSP ID: ENSP00000305459
MATAATIPSVATATAAALGEVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRNFVKEAEEISSNRRMNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEASRVHLFDIITQYRAIFSDEDPLLPPAMGEHTVNESAIFHGWVLQKVSQFLQVLETDLYRGIGGHLDSLLGQCMYFGLSFSRVGADFRGQLAPVFQRVAISTFQKAIQETVEKFQEEMNSYMLISAPAILGTSNMPAAVPATQPGTLQPPMVLLDFPPLACFLNNILVAFNDLRLCCPVALAQDVTGALEDALAKVTKIILAFHRAEEAAFSSGEQELFVQFCTVFLEDLVPYLNRCLQVLFPPAQIAQTLGIPPTQLSKYGNLGHVNIGAIQEPLAFILPKRETLFTLDDQALGPELTAPAPEPPAEEPRLEPAGPACPEGGRAETQAEPPSVGP

SEQ ID NO: 19594 - protein, 534 aa, Homo sapiens
  Payload ID: 3924
  Gene Symbol: COG8
  Gene Name: component of oligomeric golgi complex 8
  ENSP ID: ENSP00000455954
MATAATIPSVATATAAALGEVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRNFVKEAEEISSNRRMNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEASRVHLFDIITQYRAIFSDEDPLLPPAMGEHTVNESAIFHGWVLQKVSQFLQVLETDLYRGIGGHLDSLLGQCMYFGLSFSRVGADFRGQLAPVFQRVAISTFQKAIQETVEKFQEEMNSYMLISAPAILGTSNMPAAVPATQPGTLQPPMVLLDFPPLACFLNNILVAFNDLRLCCPVALAQDVTGALEDALAKVTKIILAFHRAEEAAFSSGEQELFVQFCTVFLEDLVPYLNRCLQVLFPPAQIAQTLGKRMKIL

SEQ ID NO: 19595 - protein, 223 aa, Homo sapiens
  Payload ID: 3924
  Gene Symbol: COG8
  Gene Name: component of oligomeric golgi complex 8
  ENSP ID: ENSP00000456705
  MOD_RES (1)..(1): Any amino acid
XVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRNFVKEAEEISSNRRMNSLTLNRHTEILEILEIPQLMDTCVRNSYYEEALELAAYVRRLERKYSSIPVIQGIVNEVRHAGITGGSHGARPGAFLAAHPQHQPQGQTLARMARARLCR

SEQ ID NO: 19596 - protein, 99 aa, Homo sapiens
  Payload ID: 3924
  Gene Symbol: COG8
  Gene Name: component of oligomeric golgi complex 8
  ENSP ID: ENSP00000464395
MNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFT

SEQ ID NO: 19597 - protein, 121 aa, Homo sapiens
  Payload ID: 3924
  Gene Symbol: COG8
  Gene Name: component of oligomeric golgi complex 8
  ENSP ID: ENSP00000484442
  MOD_RES (1)..(1): Any amino acid
XALGEVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRCDAPGAKGVL

SEQ ID NO: 19598 - protein, 299 aa, Homo sapiens [sequence omitted]

SEQ ID NO: 19599 - protein, 299 aa, Homo sapiens [sequence omitted]

SEQ ID NO: 19600 - protein, 57 aa, Homo sapiens
  Payload ID: 3925
  Gene Symbol: CRX
  Gene Name: cone-rod homeobox
  ENSP ID: ENSP00000457808
MMAYMNPGPHYSVNALALSGPSVDLMHQAVPYPSAPRKQRRERTTFTRSQLEELEAL

SEQ ID NO: 19601 - protein, 41 aa, Homo sapiens
  Payload ID: 3925
  Gene Symbol: CRX
  Gene Name: cone-rod homeobox
  ENSP ID: ENSP00000478106
MMAYMNPGPHYSVNALALSGPSVDLMHQAVPYPSLVQEPEG

SEQ ID NO: 19602 - protein, 349 aa, Homo sapiens
  Payload ID: 3926
  Gene Symbol: CTGF
  Gene Name: connective tissue growth factor
  Uniprot ID: P29279
  ENSP ID: ENSP00000356954
MTAASMGPVRVAFVVLLALCSRPAVGQNCSGPCRCPDEPAPRCPAGVSLVLDGCGCCRVCAKQLGELCTERDPCDPHKGLFCHFGSPANRKIGVCTAKDGAPCIFGGTVYRSGESFQSSCKYQCTCLDGAVGCMPLCSMDVRLPSPDCPFPRRVKLPGKCCEEWVCDEPKDQTVVGPALAAYRLEDTFGPDPTMIRANCLVQTTEWSACSKTCGMGISTRVTNDNASCRLEKQSRLCMVRPCEADLEENIKKGKKCIRTPKISKPIKFELSGCTSMKTYRAKFCGVCTDGRCCTPHRTTTLPVEFKCPDGEVMKKNMMFIKTCACHYNCPGDNDIFESLYYRKMYGDMA

SEQ ID NO: 19603 - protein, 713 aa, Homo sapiens
  Payload ID: 3927
  Gene Symbol: CNKSR1
  Gene Name: connector enhancer of kinase suppressor of Ras 1
  Uniprot ID: Q969H4
  ENSP ID: ENSP00000354609
MEPVETWTPGKVATWLRGLDDSLQDYPFEDWQLPGKNLLQLCPQSLEALAVRSLGHQELILGGVEQLQALSSRLQTENLQSLTEGLLGATHDFQSIVQGCLGDCAKTPIDVLCAAVELLHEADALLFWLSRYLFSHLNDFSACQEIRDLLEELSQVLHEDGPAAEKEGTVLRICSHVAGICHNILVCCPKELLEQKAVLEQVQLDSPLGLEIHTTSNCQHFVSQVDTQVPTDSRLQIQPGDEVVQINEQVVVGWPRKNMVRELLREPAGLSLVLKKIPIPETPPQTPPQVLDSPHQRSPSLSLAPLSPRAPSEDVFAFDLSSNPSPGPSPAWTDSASLGPEPLPIPPEPPAILPAGVAGTPGLPESPDKSPVGRKKSKGLATRLSRRRVSCRELGRPDCDGWLLLRKAPGGFMGPRWRRRWFVLKGHTLYWYRQPQDEKAEGLINVSNYSLESGHDQKKKYVFQLTHDVYKPFIFAADTLTDLSMWVRHLITCISKYQSPGRAPPPREEDCYSETEAEDPDDEAGSHSASPSPAQAGSPLHGDTSPAATPTQRSPRTSFGSLTDSSEEALEGMVRGLRQGGVSLLGQPQPLTQEQWRSSFMRRNRDPQLNERVHRVRALQSTLKAKLQELQVLEEVLGDPELTGEKFRQWKEQNRELYSEGLGAWGVAQAEGSSHILTSDSTEQSPHSLPSDPEEHSHLCPLTSESSLRPPDL

SEQ ID NO: 19604 - protein, 720 aa, Homo sapiens
  Payload ID: 3927
  Gene Symbol: CNKSR1
  Gene Name: connector enhancer of kinase suppressor of Ras 1
  Uniprot ID: Q969H4
  ENSP ID: ENSP00000363371
MEPVETWTPGKVATWLRGLDDSLQDYPFEDWQLPGKNLLQLCPQSLEALAVRSLGHQELILGGVEQLQALSSRLQTENLQSLTEGLLGATHDFQSIVQGCLGDCAKTPIDVLCAAVELLHEADALLFWLSRYLFSHLNDFSACQEIRDLLEELSQVLHEDGPAAEKEGTVLRICSHVAGICHNILVCCPKELLEQKAVLEQVQLDSPLGLEIHTTSNCQHFVSQVDTQVPTDSRLQIQPGDEVVQINEQVVVREERDMVGWPRKNMVRELLREPAGLSLVLKKIPIPETPPQTPPQVLDSPHQRSPSLSLAPLSPRAPSEDVFAFDLSSNPSPGPSPAWTDSASLGPEPLPIPPEPPAILPAGVAGTPGLPESPDKSPVGRKKSKGLATRLSRRRVSCRELGRPDCDGWLLLRKAPGGFMGPRWRRRWFVLKGHTLYWYRQPQDEKAEGLINVSNYSLESGHDQKKKYVFQLTHDVYKPFIFAADTLTDLSMWVRHLITCISKYQSPGRAPPPREEDCYSETEAEDPDDEAGSHSASPSPAQAGSPLHGDTSPAATPTQRSPRTSFGSLTDSSEEALEGMVRGLRQGGVSLLGQPQPLTQEQWRSSFMRRNRDPQLNERVHRVRALQSTLKAKLQELQVLEEVLGDPELTGEKFRQWKEQNRELYSEGLGAWGVAQAEGSSHILTSDSTEQSPHSLPSDPEEHSHLCPLTSESSLRPPDL

SEQ ID NO: 19605 - protein, 455 aa, Homo sapiens
  Payload ID: 3927
  Gene Symbol: CNKSR1
  Gene Name: connector enhancer of kinase suppressor of Ras 1
  ENSP ID: ENSP00000431817
MVRELLREPAGLSLVLKKIPIPETPPQTPPQVLDSPHQRSPSLSLAPLSPRAPSEDVFAFDLSSNPSPGPSPAWTDSASLGPEPLPIPPEPPAILPAGVAGTPGLPESPDKSPVGRKKSKGLATRLSRRRVSCRELGRPDCDGWLLLRKAPGGFMGPRWRRRWFVLKGHTLYWYRQPQDEKAEGLINVSNYSLESGHDQKKKYVFQLTHDVYKPFIFAADTLTDLSMWVRHLITCISKYQSPGRAPPPREEDCYSETEAEDPDDEAGSHSASPSPAQAGSPLHGDTSPAATPTQRSPRTSFGSLTDSSEEALEGMVRGLRQGGVSLLGQPQPLTQEQWRSSFMRRNRDPQLNERVHRVRALQSTLKAKLQELQVLEEVLGDPELTGEKFRQWKEQNRELYSEGLGAWGVAQAEGSSHILTSDSTEQSPHSLPSDPEEHSHLCPLTSESSLRPPDL

SEQ ID NO: 19606 - protein, 63 aa, Homo sapiens
  Payload ID: 3927
  Gene Symbol: CNKSR1
  Gene Name: connector enhancer of kinase suppressor of Ras 1
  ENSP ID: ENSP00000432057
MEPVETWTPGKVLTTPCRTIPLRTGSCLARTCSSSAPKASRLWLCGLWDTRSSSWAGWNSSRP

SEQ ID NO: 19607 - protein, 78 aa, Homo sapiens
  Payload ID: 3927
  Gene Symbol: CNKSR1
  Gene Name: connector enhancer of kinase suppressor of Ras 1
  ENSP ID: ENSP00000434047
  MOD_RES (1)..(1): Any amino acid
XIHTTSNCQHFVSQVDTQVPTDSRLQIQPGDEVVQINEQVVVGWPRKNMVRELLREPAGLSLVLKKIPIPETPPQGPI

SEQ ID NO: 19608 - protein, 229 aa, Homo sapiens
  Payload ID: 3927
  Gene Symbol: CNKSR1
  Gene Name: connector enhancer of kinase suppressor of Ras 1
  ENSP ID: ENSP00000435880
MEPVETWTPGKVATWLRGLDDSLQDYPFEDWQLPGKNLLQLCPQSLEALAVRSLGHQELILGGVEQLQALSSRLQTENLQSLTEGLLGATHDFQSIVQGCLGDCAKTPIDVLCAAVELLHEADALLFWLSRYLFSHLNDFSACQEIRDLLEELSQVLHEDGPAAEKEGTVLRIPRGWDLPQHPGLLPQGAAGTEGRARAGAAGQSIGPRNSHHQQLPALCVPSGHPGSH

SEQ ID NO: 19609 - protein, 312 aa, Homo sapiens
  Payload ID: 3927
  Gene Symbol: CNKSR1
  Gene Name: connector enhancer of kinase suppressor of Ras 1
  ENSP ID: ENSP00000437038
MEPVETWTPGKVATWLRGLDDSLQDYPFEDWQLPGKNLLQLCPQSLEALAVRSLGHQELILGGVEQLQALSSRLQTENLQSLTEGLLGATHDFQSIVQGCLGDCAKTPIDVLCAAVELLHEADALLFWLSRYLFSHLNDFSACQEIRDLLEELSQVLHEDGPAAEKEGTVLRICSHVAGICHNILVCCPKELLEQKAVLEQVQLDSPLGLEIHTTSNCQHFVSQVDTQVPTDSRLQIQPGDEVVQINEQVVVGWPRKNMVRELLREPAGLSLVLKKIPIPETPPQVTGSVQVCLGGETVGSSHPPCPPQGPI

SEQ ID NO: 19610 - protein, 898 aa, Homo sapiens
  Payload ID: 3928
  Gene Symbol: CNKSR2
  Gene Name: connector enhancer of kinase suppressor of Ras 2
  Uniprot ID: Q8WXI2
  ENSP ID: ENSP00000279451
MALIMEPVSKWSPSQVVDWMKGLDDCLQQYIKNFEREKISGDQLLRITHQELEDLGVSRIGHQELILEAVDLLCALNYGLETENLKTLSHKLNASAKNLQNFITGRRRSGHYDGRTSRKLPNDFLTSVVDLIGAAKSLLAWLDRSPFAAVTDYSVTRNNVIQLCLELTTIVQQDCTVYETENKILHVCKTLSGVCDHIISLSSDPLVSQSAHLEVIQLANIKPSEGLGMYIKSTYDGLHVITGTTENSPADRCKKIHAGDEVIQVNHQTVVGWQLKNLVNALREDPSGVILTLKKRPQSMLTSAPALLKNMRWKPLALQPLIPRSPTSSVATPSSTISTPTKRDSSALQDLYIPPPPAEPYIPRDEKGNLPCEDLRGHMVGKPVHKGSESPNSFLDQEYRKRFNIVEEDTVLYCYEYEKGRSSSQGRRESTPTYGKLRPISMPVEYNWVGDYEDPNKMKRDSRRENSLLRYMSNEKIAQEEYMFQRNSKKDTGKKSKKKGDKSNSPTHYSLLPSLQMDALRQDIMGTPVPETTLYHTFQQSSLQHKSKKKNKGPIAGKSKRRISCKDLGRGDCEGWLWKKKDAKSYFSQKWKKYWFVLKDASLYWYINEEDEKAEGFISLPEFKIDRASECRKKYAFKACHPKIKSFYFAAEHLDDMNRWLNRINMLTAGYAERERIKQEQDYWSESDKEEADTPSTPKQDSPPPPYDTYPRPPSMSCASPYVEAKHSRLSSTETSQSQSSHEEFRQEVTGSSAVSPIRKTASQRRSWQDLIETPLTSSGLHYLQTLPLEDSVFSDSAAISPEHRRQSTLPTQKCHLQDHYGPYPLAESERMQVLNGNGGKPRSFTLPRDSGFNHCCLNAPVSACDPQDDVQPPEVEEEEEEEEEEGEAAGENIGEKS

SEQ ID NO: 19611 - protein, 1034 aa, Homo sapiens
  Payload ID: 3928
  Gene Symbol: CNKSR2
  Gene Name: connector enhancer of kinase suppressor of Ras 2
  Uniprot ID: Q8WXI2
  ENSP ID: ENSP00000368824
MALIMEPVSKWSPSQVVDWMKGLDDCLQQYIKNFEREKISGDQLLRITHQELEDLGVSRIGHQELILEAVDLLCALNYGLETENLKTLSHKLNASAKNLQNFITGRRRSGHYDGRTSRKLPNDFLTSVVDLIGAAKSLLAWLDRSPFAAVTDYSVTRNNVIQLCLELTTIVQQDCTVYETENKILHVCKTLSGVCDHIISLSSDPLVSQSAHLEVIQLANIKPSEGLGMYIKSTYDGLHVITGTTENSPADRCKKIHAGDEVIQVNHQTVVGWQLKNLVNALREDPSGVILTLKKRPQSMLTSAPALLKNMRWKPLALQPLIPRSPTSSVATPSSTISTPTKRDSSALQDLYIPPPPAEPYIPRDEKGNLPCEDLRGHMVGKPVHKGSESPNSFLDQEYRKRFNIVEEDTVLYCYEYEKGRSSSQGRRESTPTYGKLRPISMPVEYNWVGDYEDPNKMKRDSRRENSLLRYMSNEKIAQEEYMFQRNSKKDTGKKSKKKGDKSNSPTHYSLLPSLQMDALRQDIMGTPVPETTLYHTFQQSSLQHKSKKKNKGPIAGKSKRRISCKDLGRGDCEGWLWKKKDAKSYFSQKWKKYWFVLKDASLYWYINEEDEKAEGFISLPEFKIDRASECRKKYAFKACHPKIKSFYFAAEHLDDMNRWLNRINMLTAGYAERERIKQEQDYWSESDKEEADTPSTPKQDSPPPPYDTYPRPPSMSCASPYVEAKHSRLSSTETSQSQSSHEEFRQEVTGSSAVSPIRKTASQRRSWQDLIETPLTSSGLHYLQTLPLEDSVFSDSAAISPEHRRQSTLPTQKCHLQDHYGPYPLAESERMQVLNGNGGKPRSFTLPRDSGFNHCCLNAPVSACDPQDDVQPPEVEEEEEEEEEEGEAAGENIGEKSESREEKLGDSLQDLYRALEQASLSPLGEHRISTKMEYKLSFIKRCNDPVMNEKLHRLRILKSTLKAREGEVAIIDKVLDNPDLTSKEFQQWKQMYLDLFLDICQNTTSNDPLSISSEVDVITSSLAHTHSYIETHV

SEQ ID NO: 19612 - protein, 1004 aa, Homo sapiens
  Payload ID: 3928
  Gene Symbol: CNKSR2
  Gene Name: connector enhancer of kinase suppressor of Ras 2
  Uniprot ID: Q8WXI2
  ENSP ID: ENSP00000397906
MALIMEPVSKWSPSQVVDWMKGLDDCLQQYIKNFEREKISGDQLLRITHQELEDLGVSRIGHQELILEAVDLLCALNYGLETENLKTLSHKLNASAKNLQNFITGRRRSGHYDGRTSRKLPNDFLTSVVDLIGAAKSLLAWLDRSPFAAVTDYSVTRNNVIQLCLELTTIVQQDCTVYETENKILHVCKTLSGVCDHIISLSSDPLVSQSAHLEVIQLANIKPSEGLGMYIKSTYDGLHVITGTTENSPADRCKKIHAGDEVIQVNHQTVVGWQLKNLVNALREDPSGVILTLKKRPQSMLTSAPALLKNMRWKPLALQPLIPRSPTSSVATPSSTISTPTKRDSSALQDLYIPPPPAEPYIPRDEKGNLPCEDLRGHMVGKPVHKGSESPNSFLDQEYRKRFNIVEEDTVLYCYEYEKGRSSSQGRRESTPTYENSLLRYMSNEKIAQEEYMFQRNSKKDTGKKSKKKGDKSNSPTHYSLLPSLQMDALRQDIMGTPVPETTLYHTFQQSSLQHKSKKKNKGPIAGKSKRRISCKDLGRGDCEGWLWKKKDAKSYFSQKWKKYWFVLKDASLYWYINEEDEKAEGFISLPEFKIDRASECRKKYAFKACHPKIKSFYFAAEHLDDMNRWLNRINMLTAGYAERERIKQEQDYWSESDKEEADTPSTPKQDSPPPPYDTYPRPPSMSCASPYVEAKHSRLSSTETSQSQSSHEEFRQEVTGSSAVSPIRKTASQRRSWQDLIETPLTSSGLHYLQTLPLEDSVFSDSAAISPEHRRQSTLPTQKCHLQDHYGPYPLAESERMQVLNGNGGKPRSFTLPRDSGFNHCCLNAPVSACDPQDDVQPPEVEEEEEEEEEEGEAAGENIGEKSESREEKLGDSLQDLYRALEQASLSPLGEHRISTKMEYKLSFIKRCNDPVMNEKLHRLRILKSTLKAREGEVAIIDKVLDNPDLTSKEFQQWKQMYLDLFLDICQNTTSNDPLSISSEVDVITSSLAHTHSYIETHV

SEQ ID NO: 19613 - protein, 849 aa, Homo sapiens
  Payload ID: 3928
  Gene Symbol: CNKSR2
  Gene Name: connector enhancer of kinase suppressor of Ras 2
  Uniprot ID: Q8WXI2
  ENSP ID: ENSP00000444633
MALIMEPVSKWSPSQVVDWMKGLDDCLQQYIKNFEREKISGDQLLRITHQELEDLGVSRIGHQELILEAVDLLCALNYGLETENLKTLSHKLNASAKNLQNFITGRRRSGHYDGRTSRKLPNDFLTSVVDLIGAAKSLLAWLDRSPFAAVTDYSVTRNNVIQLCLELTTIVQQDCTVYETENKILHVCKTLSGVCDHIISLSSDPLVSQSAHLEVIQLANIKPSEGLGMYIKSTYDGLHVITGTTENSPADRCKKIHAGDEVIQVNHQTVPLIPRSPTSSVATPSSTISTPTKRDSSALQDLYIPPPPAEPYIPRDEKGNLPCEDLRGHMVGKPVHKGSESPNSFLDQEYRKRFNIVEEDTVLYCYEYEKGRSSSQGRRESTPTYGKLRPISMPVEYNWVGDYEDPNKMKRDSRRENSLLRYMSNEKIAQEEYMFQRNSKKDTGKKSKKKGDKSNSPTHYSLLPSLQMDALRQDIMGTPVPETTLYHTFQQSSLQHKSKKKNKGPIAGKSKRRISCKDLGRGDCEGWLWKKKDAKSYFSQKWKKYWFVLKDASLYWYINEEDEKAEGFISLPEFKIDRASECRKKYAFKACHPKIKSFYFAAEHLDDMNRWLNRINMLTAGYAERERIKQEQDYWSESDKEEADTPSTPKQDSPPPPYDTYPRPPSMSCASPYVEAKHSRLSSTETSQSQSSHEEFRQEVTGSSAVSPIRKTASQRRSWQDLIETPLTSSGLHYLQTLPLEDSVFSDSAAISPEHRRQSTLPTQKCHLQDHYGPYPLAESERMQVLNGNGGKPRSFTLPRDSGFNHCCLNAPVSACDPQDDVQPPEVEEEEEEEEEEGEAAGENIGEKS

SEQ ID NO: 19614 - protein, 745 aa, Homo sapiens
  Payload ID: 3929
  Gene Symbol: CHUK
  Gene Name: conserved helix-loop-helix ubiquitous kinase
  Uniprot ID: O15111
  ENSP ID: ENSP00000359424
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLVVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMELQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 19615 - protein, 137 aa, Homo sapiens
  Payload ID: 3930
  Gene Symbol: CNST
  Gene Name: consortin, connexin sorting protein
  ENSP ID: ENSP00000355468
MDDSDTPTYYLQIEPQDGCHPGDSVERSVTCLPSASDENENQLDGDGHEHLTSSDSAMGKPQVSEQDSLNNNESCTLSCEVAAGENLQNTLCEASRDEQAFLGKDKKIPGKRSPRSKKGTAKKIPPDSRILFPGGGL

SEQ ID NO: 19616 - protein, 616 aa, Homo sapiens
  Payload ID: 3930
  Gene Symbol: CNST
  Gene Name: consortin, connexin sorting protein
  Uniprot ID: Q6PJW8
  ENSP ID: ENSP00000355469
MDDSDTPTYYLQIEPQDGCHPGDSVERSVTCLPSASDENENQLDGDGHEHLTSSDSAMGKPQVSEQDSLNNNESCTLSCEVAAGENLQNTLCEASRDEQAFLGKDKKIPGKRSPRSKKGTAKKIPPGLFSGDIAPLMQEKVLSAVTYAVDDEEAAEVNANEQPEAPKLVLQSLFSLIRGEVEQLDSRALPLCLHQIAESYFQEEDYEKAMKFIQLERLYHEQLLANLSAIQEQWETKWKTVQPHTVTALRNSEKGFNGEDFERLTKICATHQDPLLSKHKIAAVEKSQERKCSTQLLVSEDPKEGGATTKESESKTCLGTESSKESQHTVEPLGSSPCCHQMDVQTDSPSLSVTAGKDHMEELLCSAEATLALHTQSSETAGSPSGPDSSEDACEDDSRLQLAQTEACQDVARIEGIAEDPKVFLSSKSKTEPLISPGCDRIPPALISEGKYSQAQRKELRLPLRDASEALPTDQLENNELNELQQPDLTDSDGKSPQAQADSDGSENVLCGNNQISDLGILLPEVCMAPEEKGDKDDQLNKETEDYLNSLLEGCLKDTEDSLSYEDNQDDDSDLLQDLSPEEASYSLQENLPSDESCLSLDDLAKRIEIAEVNQR

SEQ ID NO: 19617 - protein, 725 aa, Homo sapiens
  Payload ID: 3930
  Gene Symbol: CNST
  Gene Name: consortin, connexin sorting protein
  Uniprot ID: Q6PJW8
  ENSP ID: ENSP00000355470
MDDSDTPTYYLQIEPQDGCHPGDSVERSVTCLPSASDENENQLDGDGHEHLTSSDSAMGKPQVSEQDSLNNNESCTLSCEVAAGENLQNTLCEASRDEQAFLGKDKKIPGKRSPRSKKGTAKKIPPGLFSGDIAPLMQEKVLSAVTYAVDDEEAAEVNANEQPEAPKLVLQSLFSLIRGEVEQLDSRALPLCLHQIAESYFQEEDYEKAMKFIQLERLYHEQLLANLSAIQEQWETKWKTVQPHTVTALRNSEKGFNGEDFERLTKICATHQDPLLSKHKIAAVEKSQERKCSTQLLVSEDPKEGGATTKESESKTCLGTESSKESQHTVEPLGSSPCCHQMDVQTDSPSLSVTAGKDHMEELLCSAEATLALHTQSSETAGSPSGPDSSEDACEDDSRLQLAQTEACQDVARIEGIAEDPKVFLSSKSKTEPLISPGCDRIPPALISEGKYSQAQRKELRLPLRDASEALPTDQLENNELNELQQPDLTDSDGKSPQAQADSDGSENVLCGNNQISDLGILLPEVCMAPEEKGDKDDQLNKETEDYLNSLLEGCLKDTEDSLSYEDNQDDDSDLLQDLSPEEASYSLQENLPSDESCLSLDDLAKRIEIAEVVPTEGLVSILKKRNDTVGDHPAQMQHKPSKRRVRFQEIDDSLDQDEVGGGSCILLVLLCIATVFLSVGGTALYCTFGDMESPVCTDFADNMDFYYTKLLQGVAELKHWIYLS

SEQ ID NO: 19618 - protein, 1007 aa, Homo sapiens
  Payload ID: 3931
  Gene Symbol: CNTN1
  Gene Name: contactin 1
  Uniprot ID: Q12860
  ENSP ID: ENSP00000261160
MKMWLLVSHLVIISITTCLAVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 19619 - protein, 1018 aa, Homo sapiens
  Payload ID: 3931
  Gene Symbol: CNTN1
  Gene Name: contactin 1
  Uniprot ID: Q12860
  ENSP ID: ENSP00000325660
MKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 19620 - protein, 1018 aa, Homo sapiens; identical to SEQ ID NO: 19619
  Payload ID: 3931
  Gene Symbol: CNTN1
  Gene Name: contactin 1
  Uniprot ID: Q12860
  ENSP ID: ENSP00000447006

SEQ ID NO: 19621 - protein, 90 aa, Homo sapiens
  Payload ID: 3931
  Gene Symbol: CNTN1
  Gene Name: contactin 1
  ENSP ID: ENSP00000447860
MKMWLLVSHLVIISITTCLAEFTWYRRYGHGVSEEDKGFGPIFEEQPINTIYPEESLEGKVSLNCRARASPFPVYKWRMNNGDVDLTSDR

SEQ ID NO: 19622 - protein, 85 aa, Homo sapiens
  Payload ID: 3931
  Gene Symbol: CNTN1
  Gene Name: contactin 1
  ENSP ID: ENSP00000447862
MKMWLLVSHLVIISITTCLAEFTWYRRYGHGVSEEDKGFGPIFEEQPINTIYPEESLEGKVSLNCRARASPFPVYKWRMNNGDVD

SEQ ID NO: 19623 - protein, 627 aa, Homo sapiens
  Payload ID: 3931
  Gene Symbol: CNTN1
  Gene Name: contactin 1
  Uniprot ID: Q12860
  ENSP ID: ENSP00000448004
MKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGKNRKGGEKNMVDSFLPVCASLPPTW

SEQ ID NO: 19624 - protein, 627 aa, Homo sapiens; identical to SEQ ID NO: 19623
  Payload ID: 3931
  Gene Symbol: CNTN1
  Gene Name: contactin 1
  Uniprot ID: Q12860
  ENSP ID: ENSP00000448653

SEQ ID NO: 19625 - protein, 57 aa, Homo sapiens
  Payload ID: 3931
  Gene Symbol: CNTN1
  Gene Name: contactin 1
  ENSP ID: ENSP00000449517
KHSIEVPIPRDGEYVVEVRAHSDGGDGVVSQVKISEGKSTSLRSKTAKDHRSIRTMS

SEQ ID NO: 19626 - protein, 72 aa, Homo sapiens
  Payload ID: 3931
  Gene Symbol: CNTN1
  Gene Name: contactin 1
  ENSP ID: ENSP00000449706
MKMWLLVSHLVIISITTCLAEFTWYRRYGHGVSEEDKGFGPIFEEQPINTIYPEESLEGKVSLNCRARASPF

SEQ ID NO: 19627 - protein, 62 aa, Homo sapiens
  Payload ID: 3931
  Gene Symbol: CNTN1
  Gene Name: contactin 1
  ENSP ID: ENSP00000450412
MKMWLLVSHLVIISITTCLAEFTWYRRYGHGVSEEDKGFGPIFEEQPINTIYPEESLEGKVS

SEQ ID NO: 19628 - protein, 1040 aa, Homo sapiens
  Payload ID: 3932
  Gene Symbol: CNTN2
  Gene Name: contactin 2 (axonal)
  Uniprot ID: Q02246
  ENSP ID: ENSP00000330633
MGTATRRKPHLLLVAAVALVSSSAWSSALGSQTTFGPVFEDQPLSVLFPEESTEEQVLLACRARASPPATYRWKMNGTEMKLEPGSRHQLVGGNLVIMNPTKAQDAGVYQCLASNPVGTVVSREAILRFGFLQEFSKEERDPVKAHEGWGVMLPCNPPAHYPGLSYRWLLNEFPNFIPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYLLSFRRQGSTHWQTARVPGADAQYFVYSNESVRPYTPFEVKIRSYNRRGDGPESLTALVYSAEEEPRVAPTKVWAKGVSSSEMNVTWEPVQQDMNGILLGYEIRYWKAGDKEAAADRVRTAGLDTSARVSGLHPNTKYHVTVRAYNRAGTGPASPSANATTMKPPPRRPPGNISWTFSSSSLSIKWDPVVPFRNESAVTGYKMLYQNDLHLTPTLHLTGKNWIEIPVPEDIGHALVQIRTTGPGGDGIPAEVHIVRNGGTSMMVENMAVRPAPHPGTVISHSVAMLILIGSLEL

SEQ ID NO: 19629 - protein, 1028 aa, Homo sapiens
  Payload ID: 3933
  Gene Symbol: CNTN3
  Gene Name: contactin 3 (plasmacytoma associated)
  Uniprot ID: Q9P232
  ENSP ID: ENSP00000263665
MMFPWKQLILLSFIGCLGGELLLQGPVFIKEPSNSIFPVGSEDKKITLHCEARGNPSPHYRWQLNGSDIDMSMEHRYKLNGGNLVVINPNRNWDTGTYQCFATNSLGTIVSREAKLQFAYLENFKTKMRSTVSVREGQGVVLLCGPPPHSGELSYAWIFNEYPSFVEEDSRRFVSQETGHLYISKVEPSDVGNYTCVVTSMVTNARVLGSPTPLVLRSDGVMGEYEPKIEVQFPETLPAAKGSTVKLECFALGNPIPQINWRRSDGLPFSSKIKLRKFSGVLEIPNFQQEDAGSYECIAENSRGKNVARGRLTYYAKPHWVQLIKDVEIAVEDSLYWECRASGKPKPSYRWLKNGAALVLEERTQIENGALTISNLSVTDSGMFQCIAENKHGLVYSSAELKVVASAPDFSKNPMKKLVQVQVGSLVSLDCKPRASPRALSSWKKGDVSVQEHERISLLNDGGLKIANVTKADAGTYTCMAENQFGKANGTTHLVVTEPTRITLAPSNMDVSVGESVILPCQVQHDPLLDIIFTWYFNGALADFKKDGSHFEKVGGSSSGDLMIRNIQLKHSGKYVCMVQTGVDSVSSAADLIVRGSPGPPENVKVDEITDTTAQLSWKEGKDNHSPVISYSIQARTPFSVGWQTVTTVPEVIDGKTHTATVVELNPWVEYEFRVVASNKIGGGEPSLPSEKVRTEEAVPEVPPSEVNGGGGSRSELVITWDPVPEELQNGEGFGYVVAFRPLGVTTWIQTVVTSPDTPRYVFRNESIVPYSPYEVKVGVYNNKGEGPFSPVTTVFSAEEEPTVAPSQVSANSLSSSEIEVSWNTIPWKLSNGHLLGYEVRYWNGGGKEESSSKMKVAGNETSARLRGLKSNLAYYTAVRAYNSAGAGPFSATVNVTTKKTPPSQPPGNVVWNATDTKVLLNWEQVKAMENESEVTGYKVFYRTSSQNNVQVLNTNKTSAELVLPIKEDYIIEVKATTDGGDGTSSEQIRIPRITSMDARGSTSAISNVHPMSSYMPIVLFLIVYVLW

SEQ ID NO: 19630 - protein, 698 aa, Homo sapiens
  Payload ID: 3934
  Gene Symbol: CNTN4
  Gene Name: contactin 4
  Uniprot ID: Q8IWV2
  ENSP ID: ENSP00000380600
MEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENERITISEDGNLRIINVTKSDAGSYTCIATNHFGTASSTGNLVVKDPTRVMVPPSSMDVTVGESIVLPCQVTHDHSLDIVFTWSFNGHLIDFDRDGDHFERVGGQDSAGDLMIRNIQLKHAGKYVCMVQTSVDRLSAAADLIVRGPPGPPEAVTIDEITDTTAQLSWRPGPDNHSPITMYVIQARTPFSVGWQAVSTVPELIDGKTFTATVVGLNPWVEYEFRTVAANVIGIGEPSRPSEKRRTEEALPEVTPANVSGGGGSKSELVITWETVPEELQNGRGFGYVVAFRPYGKMIWMLTVLASADASRYVFRNESVHPFSPFEVKVGVFNNKGEGPFSPTTVVYSAEEEPTKPPASIFARSLSATDIEVFWASPLEKNRGRIQGYEVKYWRHEDKEENARKIRTVGNQTSTKITNLKGSVLYHLAVKAYNSAGTGPSSATVNVTTRKPPPSQPPGNIIWNSSDSKIILNWDQVKALDNESEVKGYKVLYRWNRQSSTSVIETNKTSVELSLPFDEDYIIEIKPFSDGGDGSSSEQIRIPKISNAYARGSGASTSNACTLSAISTIMISLTARSSL

SEQ ID NO: 19631 - protein, 1026 aa, Homo sapiens
  Payload ID: 3934
  Gene Symbol: CNTN4
  Gene Name: contactin 4
  Uniprot ID: Q8IWV2
  ENSP ID: ENSP00000380602
MRLPWELLVLQSFILCLADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKLQFAYLDNFKTRTRSTVSVRRGQGMVLLCGPPPHSGELSYAWIFNEYPSYQDNRRFVSQETGNLYIAKVEKSDVGNYTCVVTNTVTNHKVLGPPTPLILRNDGVMGEYEPKIEVQFPETVPTAKGATVKLECFALGNPVPTIIWRRADGKPIARKARRHKSNGILEIPNFQQEDAGLYECVAENSRGKNVARGQLTFYAQPNWIQKINDIHVAMEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENERITISEDGNLRIINVTKSDAGSYTCIATNHFGTASSTGNLVVKDPTRVMVPPSSMDVTVGESIVLPCQVTHDHSLDIVFTWSFNGHLIDFDRDGDHFERVGGQDSAGDLMIRNIQLKHAGKYVCMVQTSVDRLSAAADLIVRGPPGPPEAVTIDEITDTTAQLSWRPGPDNHSPITMYVIQARTPFSVGWQAVSTVPELIDGKTFTATVVGLNPWVEYEFRTVAANVIGIGEPSRPSEKRRTEEALPEVTPANVSGGGGSKSELVITWETVPEELQNGRGFGYVVAFRPYGKMIWMLTVLASADASRYVFRNESVHPFSPFEVKVGVFNNKGEGPFSPTTVVYSAEEEPTKPPASIFARSLSATDIEVFWASPLEKNRGRIQGYEVKYWRHEDKEENARKIRTVGNQTSTKITNLKGSVLYHLAVKAYNSAGTGPSSATVNVTTRKPPPSQPPGNIIWNSSDSKIILNWDQVKALDNESEVKGYKVLYRWNRQSSTSVIETNKTSVELSLPFDEDYIIEIKPFSDGGDGSSSEQIRIPKISNAYARGSGASTSNACTLSAISTIMISLTARSSL

SEQ ID NO: 19632 - protein, 54 aa, Homo sapiens
  Payload ID: 3934
  Gene Symbol: CNTN4
  Gene Name: contactin 4
  ENSP ID: ENSP00000390560
MRLPWELLVLQSFILCLADDSTLHGPIFIQEPSPVMFPLDSEEKKVKLNCEVKG

SEQ ID NO: 19633 - protein, 1026 aa, Homo sapiens; identical to SEQ ID NO: 19631
  Payload ID: 3934
  Gene Symbol: CNTN4
  Gene Name: contactin 4
  Uniprot ID: Q8IWV2
  ENSP ID: ENSP00000396010

SEQ ID NO: 19634 - protein, 232 aa, Homo sapiens
  Payload ID: 3934
  Gene Symbol: CNTN4
  Gene Name: contactin 4
  ENSP ID: ENSP00000396719
MRLPWELLVLQSFILCLADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKLQFAYLDNFKTRTRSTVSVRRGQGMVLLCGPPPHSGELSYAWIFNEYPSYQDNRRFVSQETGNLYIAKVEKSDVGNYTCVVTNTVTNHKVLGPPTPLILRNDVQYQLLSGEELMESQ

SEQ ID NO: 19635 - protein, 137 aa, Homo sapiens
  Payload ID: 3934
  Gene Symbol: CNTN4
  Gene Name: contactin 4
  ENSP ID: ENSP00000404085
MRLPWELLVLQSFILCLAGSQTDFWSLLGVLPALEADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKLQFA

SEQ ID NO: 19636 - protein, 116 aa, Homo sapiens
  Payload ID: 3934
  Gene Symbol: CNTN4
  Gene Name: contactin 4
  ENSP ID: ENSP00000408594
MRLPWELLVLQSFILCLADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKL

SEQ ID NO: 19637 - protein, 1026 aa, Homo sapiens; identical to SEQ ID NO: 19631
  Payload ID: 3934
  Gene Symbol: CNTN4
  Gene Name: contactin 4
  Uniprot ID: Q8IWV2
  ENSP ID: ENSP00000413642

SEQ ID NO: 19638 - protein, 143 aa, Homo sapiens
  Payload ID: 3934
  Gene Symbol: CNTN4
  Gene Name: contactin 4
  ENSP ID: ENSP00000422120
NDIHVAMEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENESVHQGFGSGSAPL

SEQ ID NO: 19639 - protein, 1084 aa, Homo sapiens
  Payload ID: 3935
  Gene Symbol: CNTN5
  Gene Name: contactin 5
  ENSP ID: ENSP00000279463
LTEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 19640 - protein, 1026 aa, Homo sapiens
  Payload ID: 3935
  Gene Symbol: CNTN5
  Gene Name: contactin 5
  Uniprot ID: O94779
  ENSP ID: ENSP00000393229
MASSWKLMLFLSVTMCLSESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 19641 - protein, 911 aa, Homo sapiens
  Payload ID: 3935
  Gene Symbol: CNTN5
  Gene Name: contactin 5
  Uniprot ID: O94779
  ENSP ID: ENSP00000433575
MASSWKLMLFLSVTMCLSEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEV

SEQ ID NO: 19642 - protein, 1100 aa, Homo sapiens
  Payload ID: 3935
  Gene Symbol: CNTN5
  Gene Name: contactin 5
  Uniprot ID: O94779
  ENSP ID: ENSP00000435637
MASSWKLMLFLSVTMCLSEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 19643 - protein, 1100 aa, Homo sapiens; identical to SEQ ID NO: 19642
  Payload ID: 3935
  Gene Symbol: CNTN5
  Gene Name: contactin 5
  Uniprot ID: O94779
  ENSP ID: ENSP00000436185

SEQ ID NO: 19644 - protein, 1022 aa, Homo sapiens [sequence omitted]

SEQ ID NO: 19645 - protein, 1028 aa, Homo sapiens
  Payload ID: 3936
  Gene Symbol: CNTN6
  Gene Name: contactin 6
  Uniprot ID: Q9UQ52
  ENSP ID: ENSP00000341882
MRLLWKLVILLPLINSSAGDGLLSRPIFTQEPHDVIFPLDLSKSEVILNCAANGYPSPHYRWKQNGTDIDFTMSYHYRLDGGSLAINSPHTDQDIGMYQCLATNLLGTILSRKAKLQFAYIEDFETKTRSTVSVREGQGVVLLCGPPPHFGDLSYAWTFNDNPLYVQEDNRRFVSQETGNLYIAKVEPSDVGNYTCFITNKEAQRSVQGPPTPLVQRTDGVMGEYEPKIEVRFPETIQAAKDSSVKLECFALGNPVPDISWRRLDGSPLPGKVKYSKSQAILEIPNFQQEDEGFYECIASNLRGRNLAKGQLIFYAPPEWEQKIQNTHLSIYDNLLWECKASGKPNPWYTWLKNGERLNPEERIQIENGTLIITMLNVSDSGVYQCAAENKYQIIYANAELRVLASAPDFSKSPVKKKSFVQVGGDIVIGCKPNAFPRAAISWKRGTETLRQSKRIFLLEDGSLKIYNITRSDAGSYTCIATNQFGTAKNTGSLIVKERTVITVPPSKMDVTVGESIVLPCQVSHDPSIEVVFVWFFNGDVIDLKKGVAHFERIGGESVGDLMIRNIQLHHSGKYLCTVQTTLESLSAVADIIVRGPPGPPEDVQVEDISSTTSQLSWRAGPDNNSPIQIFTIQTRTPFSVGWQAVATVPEILNGKTYNATVVGLSPWVEYEFRVVAGNSIGIGEPSEPSELLRTKASVPVVAPVNIHGGGGSRSELVITWESIPEELQNGEGFGYIIMFRPVGSTTWSKEKVSSVESSRFVYRNESIIPLSPFEVKVGVYNNEGEGSLSTVTIVYSGEDEPQLAPRGTSLQSFSASEMEVSWNAIAWNRNTGRVLGYEVLYWTDDSKESMIGKIRVSGNVTTKNITGLKANTIYFASVRAYNTAGTGPSSPPVNVTTKKSPPSQPPANIAWKLTNSKLCLNWEHVKTMENESEVLGYKILYRQNRQSKTHILETNNTSAELLVPFEEDYLIEIRTVSDGGDGSSSEEIRIPKMSSLSSRGIQFLEPSTHFLSIVIVIFHCFAIQPLI

SEQ ID NO: 19646 - protein, 41 aa, Homo sapiens
  Payload ID: 3936
  Gene Symbol: CNTN6
  Gene Name: contactin 6
  ENSP ID: ENSP00000377804
METGNSAATHKLFCRKVYISPILLLTGLRLWLLHLEIYLLC

SEQ ID NO: 19647 - protein, 63 aa, Homo sapiens
  Payload ID: 3936
  Gene Symbol: CNTN6
  Gene Name: contactin 6
  ENSP ID: ENSP00000380616
MALEWQLLSALSDSVKVDEDRAGFQCRKNFPFEYSKRELCTCASRTDCLAPTGMQQERSVFHA

SEQ ID NO: 19648 - protein, 1028 aa, Homo sapiens; identical to SEQ ID NO: 19645
  Payload ID: 3936
  Gene Symbol: CNTN6
  Gene Name: contactin 6
  Uniprot ID: Q9UQ52
  ENSP ID: ENSP00000407822

SEQ ID NO: 19649 - protein, 63 aa, Homo sapiens; identical to SEQ ID NO: 19647
  Payload ID: 3936
  Gene Symbol: CNTN6
  Gene Name: contactin 6
  ENSP ID: ENSP00000408460

SEQ ID NO: 19650 - protein, 1384 aa, Homo sapiens
  Payload ID: 3937
  Gene Symbol: CNTNAP1
  Gene Name: contactin associated protein 1
  Uniprot ID: P78357
  ENSP ID: ENSP00000264638
MMHLRLFCILLAAVSGAEGWGYYGCDEELVGPLYARSLGASSYYSLLTAPRFARLHGISGWSPRIGDPNPWLQIDLMKKHRIRAVATQGSFNSWDWVTRYMLLYGDRVDSWTPFYQRGHNSTFFGNVNESAVVRHDLHFHFTARYIRIVPLAWNPRGKIGLRLGLYGCPYKADILYFDGDDAISYRFPRGVSRSLWDVFAFSFKTEEKDGLLLHAEGAQGDYVTLELEGAHLLLHMSLGSSPIQPRPGHTTVSAGGVLNDQHWHYVRVDRFGRDVNFTLDGYVQRFILNGDFERLNLDTEMFIGGLVGAARKNLAYRHNFRGCIENVIFNRVNIADLAVRRHSRITFEGKVAFRCLDPVPHPINFGGPHNFVQVPGFPRRGRLAVSFRFRTWDLTGLLLFSRLGDGLGHVELTLSEGQVNVSIAQSGRKKLQFAAGYRLNDGFWHEVNFVAQENHAVISIDDVEGAEVRVSYPLLIRTGTSYFFGGCPKPASRWDCHSNQTAFHGCMELLKVDGQLVNLTLVEGRRLGFYAEVLFDTCGITDRCSPNMCEHDGRCYQSWDDFICYCELTGYKGETCHTPLYKESCEAYRLSGKTSGNFTIDPDGSGPLKPFVVYCDIRENRAWTVVRHDRLWTTRVTGSSMERPFLGAIQYWNASWEEVSALANASQHCEQWIEFSCYNSRLLNTAGGYPYSFWIGRNEEQHFYWGGSQPGIQRCACGLDRSCVDPALYCNCDADQPQWRTDKGLLTFVDHLPVTQVVIGDTNRSTSEAQFFLRPLRCYGDRNSWNTISFHTGAALRFPPIRANHSLDVSFYFRTSAPSGVFLENMGGPYCQWRRPYVRVELNTSRDVVFAFDVGNGDENLTVHSDDFEFNDDEWHLVRAEINVKQARLRVDHRPWVLRPMPLQTYIWMEYDQPLYVGSAELKRRPFVGCLRAMRLNGVTLNLEGRANASEGTSPNCTGHCAHPRLPCFHGGRCVERYSYYTCDCDLTAFDGPYCNHDIGGFFEPGTWMRYNLQSALRSAAREFSHMLSRPVPGYEPGYIPGYDTPGYVPGYHGPGYRLPDYPRPGRPVPGYRGPVYNVTGEEVSFSFSTSSAPAVLLYVSSFVRDYMAVLIKDDGTLQLRYQLGTSPYVYQLTTRPVTDGQPHSINITRVYRNLFIQVDYFPLTEQKFSLLVDSQLDSPKALYLGRVMETGVIDPEIQRYNTPGFSGCLSGVRFNNVAPLKTHFRTPRPMTAELAEALRVQGELSESNCGAMPRLVSEVPPELDPWYLPPDFPYYHDEGWVAILLGFLVAFLLLGLVGMLVLFYLQNHRYKGSYHTNEPKAAHEYHPGSKPPLPTSGPAQVPTPTAAPNQAPASAPAPAPTPAPAPGPRDQNLPQILEESRSE

SEQ ID NO: 19651 - protein, 740 aa, Homo sapiens
  Payload ID: 3937
  Gene Symbol: CNTNAP1
  Gene Name: contactin associated protein 1
  ENSP ID: ENSP00000466571
MMHLRLFCILLAAVSGAEGWGYYGCDEELVGPLYARSLGASSYYSLLTAPRFARLHGISGWSPRIGDPNPWLQIDLMKKHRIRAVATQGSFNSWDWVTRYMLLYGDRVDSWTPFYQRGHNSTFFGNVNESAVVRHDLHFHFTARYIRIVPLAWNPRGKIGLRLGLYGCPYKADILYFDGDDAISYRFPRGVSRSLWDVFAFSFKTEEKDGLLLHAEGAQGDYVTLELEGAHLLLHMSLGSSPIQPRPGHTTVSAGGVLNDQHWHYVRVDRFGRDVNFTLDGYVQRFILNGDFERLNLDTEMFIGGLVGAARKNLAYRHNFRGCIENVIFNRVNIADLAVRRHSRITFEGKVAFRCLDPVPHPINFGGPHNFVQVPGFPRRGRLAVSFRFRTWDLTGLLLFSRLGDGLGHVELTLSEGQVNVSIAQSGRKKLQFAAGYRLNDGFWHEVNFVAQENHAVISIDDVEGAEVRVSYPLLIRTGTSYFFGGCPKPASRWDCHSNQTAFHGCMELLKVDGQLVNLTLVEGRRLGFYAEVLFDTCGITDRCSPNMCEHDGRCYQSWDDFICYCELTGYKGETCHTPLYKESCEAYRLSGKTSGNFTIDPDGSGPLKPFVVYCDIRENRAWTVVRHDRLWTTRVTGSSMERPFLGAIQYWNASWEEVSALANASQHCEQWIEFSCYNSRLLNTAAFGLAEMRSSTSTGEAPSLGSSAVPVVWTGAVWTLPCTATVTLTSPSGELTRDC

SEQ ID NO: 19652 - protein, 1331 aa, Homo sapiens
  Payload ID: 3938
  Gene Symbol: CNTNAP2
  Gene Name: contactin associated protein-like 2
  Uniprot ID: Q9UHC6
  ENSP ID: ENSP00000354778
MQAAPRAGCGAALLLWIVSSCLCRAWTAPSTSQKCDEPLVSGLPHVAFSSSSSISGSYSPGYAKINKRGGAGGWSPSDSDHYQWLQVDFGNRKQISAIATQGRYSSSDWVTQYRMLYSDTGRNWKPYHQDGNIWAFPGNINSDGVVRHELQHPIIARYVRIVPLDWNGEGRIGLRIEVYGCSYWADVINFDGHVVLPYRFRNKKMKTLKDVIALNFKTSESEGVILHGEGQQGDYITLELKKAKLVLSLNLGSNQLGPIYGHTSVMTGSLLDDHHWHSVVIERQGRSINLTLDRSMQHFRTNGEFDYLDLDYEITFGGIPFSGKPSSSSRKNFKGCMESINYNGVNITDLARRKKLEPSNVGNLSFSCVEPYTVPVFFNATSYLEVPGRLNQDLFSVSFQFRTWNPNGLLVFSHFADNLGNVEIDLTESKVGVHINITQTKMSQIDISSGSGLNDGQWHEVRFLAKENFAILTIDGDEASAVRTNSPLQVKTGEKYFFGGFLNQMNNSSHSVLQPSFQGCMQLIQVDDQLVNLYEVAQRKPGSFANVSIDMCAIIDRCVPNHCEHGGKCSQTWDSFKCTCDETGYSGATCHNSIYEPSCEAYKHLGQTSNYYWIDPDGSGPLGPLKVYCNMTEDKVWTIVSHDLQMQTPVVGYNPEKYSVTQLVYSASMDQISAITDSAEYCEQYVSYFCKMSRLLNTPDGSPYTWWVGKANEKHYYWGGSGPGIQKCACGIERNCTDPKYYCNCDADYKQWRKDAGFLSYKDHLPVSQVVVGDTDRQGSEAKLSVGPLRCQGDRNYWNAASFPNPSSYLHFSTFQGETSADISFYFKTLTPWGVFLENMGKEDFIKLELKSATEVSFSFDVGNGPVEIVVRSPTPLNDDQWHRVTAERNVKQASLQVDRLPQQIRKAPTEGHTRLELYSQLFVGGAGGQQGFLGCIRSLRMNGVTLDLEERAKVTSGFISGCSGHCTSYGTNCENGGKCLERYHGYSCDCSNTAYDGTFCNKDVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 19653 - protein, 108 aa, Homo sapiens
  Payload ID: 3938
  Gene Symbol: CNTNAP2
  Gene Name: contactin associated protein-like 2
  Uniprot ID: Q9UHC6
  ENSP ID: ENSP00000481057
MSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 19654 - protein, 119 aa, Homo sapiens
  Payload ID: 3938
  Gene Symbol: CNTNAP2
  Gene Name: contactin associated protein-like 2
  ENSP ID: ENSP00000485955
MQAAPRAGCGAALLLWIVSSCLCRAWTAPSTSQKCDEPLVSGLPHVAFSSSSSISGSYSPGYAKINKRGGAGGWSPSDSDHYQWLQVDFGNRKQISAIATQGRYSSSDWVTQYRMLYSD

SEQ ID NO: 19655 - protein, 108 aa, Homo sapiens; identical to SEQ ID NO: 19653
  Payload ID: 3938
  Gene Symbol: CNTNAP2
  Gene Name: contactin associated protein-like 2
  Uniprot ID: Q9UHC6
  ENSP ID: ENSP00000486292

SEQ ID NO: 19656 - protein, 390 aa, Homo sapiens
  Payload ID: 3938
  Gene Symbol: CNTNAP2
  Gene Name: contactin associated protein-like 2
  ENSP ID: ENSP00000487516
MNGVTLDLEERAKVTSGFISGCSGHCTSYGTNCENGGKCLERYHGYSCDCSNTAYDGTFCNKDVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 19657 - protein, 328 aa, Homo sapiens
  Payload ID: 3938
  Gene Symbol: CNTNAP2
  Gene Name: contactin associated protein-like 2
  ENSP ID: ENSP00000487946
  MOD_RES (1)..(1): Any amino acid
XVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 19658 - protein, 328 aa, Homo sapiens; identical to SEQ ID NO: 19657
  Payload ID: 3938
  Gene Symbol: CNTNAP2
  Gene Name: contactin associated protein-like 2
  ENSP ID: ENSP00000488754
  MOD_RES (1)..(1): Any amino acid

SEQ ID NO: 19659 - protein, 1288 aa, Homo sapiens
  Payload ID: 3939
  Gene Symbol: CNTNAP3
  Gene Name: contactin associated protein-like 3
  Uniprot ID: Q9BZ76
  ENSP ID: ENSP00000297668
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSTKKQVILSSGTEFNAVKSLILGKVLEAAGADPDTRRAATSGFTGCLSAVRFGRAAPLKAALRPSGPSRVTVRGHVAPMARCAAGAASGSPARELAPRLAGGAGRSGPADEGEPLVNADRRDSAVIGGVIAVVIFILLCITAIAIRIYQQRKLRKENESKVSKKEEC

SEQ ID NO: 19660 - protein, 1039 aa, Homo sapiens
  Payload ID: 3939
  Gene Symbol: CNTNAP3
  Gene Name: contactin associated protein-like 3
  ENSP ID: ENSP00000350863
MEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVIPQMQKSN

SEQ ID NO: 19661 - protein, 1207 aa, Homo sapiens
  Payload ID: 3939
  Gene Symbol: CNTNAP3
  Gene Name: contactin associated protein-like 3
  ENSP ID: ENSP00000366884
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTDAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSTKKQVILSSGTEFNAVKSLILGKVLEAAGADPDTRRAATSGFTGCLSAVRFGRAAPLKAALRPSGPSRVTVRGHVAPMARCAAGAASGSPARELAPRLAGGAGRSGPADEGEPLVNADRRDSAVIGGVIAVVIFILLCITAIAIRIYQQRKLRKENESKVSKKEEC

SEQ ID NO: 19662 - protein, 745 aa, Homo sapiens
  Payload ID: 3939
  Gene Symbol: CNTNAP3
  Gene Name: contactin associated protein-like 3
  ENSP ID: ENSP00000366887
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTDAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEW

SEQ ID NO: 19663 - protein, 604 aa, Homo sapiens
  Payload ID: 3939
  Gene Symbol: CNTNAP3
  Gene Name: contactin associated protein-like 3
  ENSP ID: ENSP00000432863
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGALYEQSCEAHKHRGNPSGLYYIDADGSGPLGPFLVYCNMTDAAWTVVQHGGPDAVTLRGAPSGHPRSAVSFAYAAGAGQLRSAVNLAERCEQRLALRCGTARRPDSRGLVTQ

SEQ ID NO: 19664 - protein, 380 aa, Homo sapiens
  Payload ID: 3940
  Gene Symbol: CNTNAP3B
  Gene Name: contactin associated protein-like 3B
  Uniprot ID: Q96NU0
  ENSP ID: ENSP00000276974
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMELAHGLQDQNLKISLTVCHQTTQ

SEQ ID NO: 19665 - protein, 605 aa, Homo sapiens
  Payload ID: 3940
  Gene Symbol: CNTNAP3B
  Gene Name: contactin associated protein-like 3B
  ENSP ID: ENSP00000432883
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGALYEQSCEAHKHRGNPSGLYYIDADGSGPLGPFLVYCNMTADSAWTVVRHGGPDAVTLRGAPSGHPLSAVSFAYAAGAGQLRAAVNLAERCEQRLALRCGTARRPDSRGLVTQ

SEQ ID NO: 19666 - protein, 652 aa, Homo sapiens
  Payload ID: 3940
  Gene Symbol: CNTNAP3B
  Gene Name: contactin associated protein-like 3B
  ENSP ID: ENSP00000478659
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGALYEQSCEAHKHRGNPSGLYYIDADGSGPLGPFLVYCNMTDSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEW

SEQ ID NO: 19667 - protein, 1288 aa, Homo sapiens
  Payload ID: 3940
  Gene Symbol: CNTNAP3B
  Gene Name: contactin associated protein-like 3B
  ENSP ID: ENSP00000478671
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGGCLGNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEWTSDTIVLSQKEHLPVTQIVMTDTGQPHSEADYTLGPLLCRGDKSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSAKKQVILSSGTEFNAVKSLILGKVLEAAGADPDTRRAATSGFTGCLSAVRFGCAAPLKAALRPSGPSRVTVRGHVAPMARCAAGAASGSPARELAPRLAGGAGRSGPVDEGEPLVNADRRDSAVIGGVIAVEIFILLCITAIAIRIYQQRKLRKENESKVSKKEEC

SEQ ID NO: 19668 - protein, 745 aa, Homo sapiens
  Payload ID: 3940
  Gene Symbol: CNTNAP3B
  Gene Name: contactin associated protein-like 3B
  ENSP ID: ENSP00000481131
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGGCLGNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTDSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEW

SEQ ID NO: 19669 - protein, 966 aa, Homo sapiens
  Payload ID: 3940
  Gene Symbol: CNTNAP3B
  Gene Name: contactin associated protein-like 3B
  ENSP ID: ENSP00000482254
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGALYEQSCEAHKHRGNPSGLYYIDADGSGPLGPFLVYCNMTDSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEWTSDTIVLSQKEHLPVTQIVMTDTGQPHSEADYTLGPLLCRGDKSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLKFAD

SEQ ID NO: 19670 - protein, 180 aa, Homo sapiens
  Payload ID: 3940
  Gene Symbol: CNTNAP3B
  Gene Name: contactin associated protein-like 3B
  ENSP ID: ENSP00000483642
  MOD_RES (1)..(1): Any amino acid
XRDVTLTREMITLSFRTTRTPSLLLYVSSFYEEYLSVILANNGSLQIRYKLDRHQNPDAFTFDFKNMADGQLHQVKINREEAVVMVEVNQSAKKQVILSSGTEFNAVKSLILGKVLGRSGPVDEGEPLVNADRRDSAVIGGVIAVEIFILLCITAIAIRIYQQRKLRKENESKVSKKEEC

SEQ ID NO: 19671 - protein, 1207 aa, Homo sapiens
  Payload ID: 3940
  Gene Symbol: CNTNAP3B
  Gene Name: contactin associated protein-like 3B
  ENSP ID: ENSP00000483830
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGGCLGNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTDSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEWTSDTIVLSQKEHLPVTQIVMTDTGQPHSEADYTLGPLLCRGDKSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSAKKQVILSSGTEFNAVKSLILGKVLEAAGADPDTRRAATSGFTGCLSAVRFGCAAPLKAALRPSGPSRVTVRGHVAPMARCAAGAASGSPARELAPRLAGGAGRSGPVDEGEPLVNADRRDSAVIGGVIAVEIFILLCITAIAIRIYQQRKLRKENESKVSKKEEC

SEQ ID NO: 19672 - protein, 167 aa, Homo sapiens
  Payload ID: 3940
  Gene Symbol: CNTNAP3B
  Gene Name: contactin associated protein-like 3B
  ENSP ID: ENSP00000484919
  MOD_RES (1)..(1): Any amino acid
XSAAPGLTRTSDTIVLSQKEHLPVTQIVMTDTGQPHSEADYTLGPLLCRGDTRLLKVWRRESVIFEIFPSLFGRLRWEDGLSQGVQHKPGQDESFWNSASFNTETSYLHFPAFHGELTADVCFFFKTTVSSGVFMENLGITDFIRIELRGRLATLDKSQGTHYLAIK

SEQ ID NO: 19673 - protein, 1308 aa, Homo sapiens
  Payload ID: 3941
  Gene Symbol: CNTNAP4
  Gene Name: contactin associated protein-like 4
  ENSP ID: ENSP00000306893
MGSVTGAVLKTLLLLSTQNWNRVEAGNSYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEISFGGIPAPGKSVSFPHRNFHGCLENLYYNGVDIIDLAKQQKPQIIAMGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGDLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 19674 - protein, 1311 aa, Homo sapiens
  Payload ID: 3941
  Gene Symbol: CNTNAP4
  Gene Name: contactin associated protein-like 4
  ENSP ID: ENSP00000417628
MLLFYLLVVLSIDSTKASALTNPNVALFLLADDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEISFGGIPAPGKSVSFPHRNFHGCLENLYYNGVDIIDLAKQQKPQIIAMGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGSLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 19675 - protein, 1235 aa, Homo sapiens
  Payload ID: 3941
  Gene Symbol: CNTNAP4
  Gene Name: contactin associated protein-like 4
  Uniprot ID: Q9C0A0
  ENSP ID: ENSP00000418741
MWNYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGSLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 19676 - protein, 1260 aa, Homo sapiens
  Payload ID: 3941
  Gene Symbol: CNTNAP4
  Gene Name: contactin associated protein-like 4
  ENSP ID: ENSP00000439733
MGSVTGAVLKTLLLLSTQNWNRVEAGNSYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGDLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 19677 - protein, 1260 aa, Homo sapiens
  Payload ID: 3941
  Gene Symbol: CNTNAP4
  Gene Name: contactin associated protein-like 4
  ENSP ID: ENSP00000477698
MGSVTGAVLKTLLLLSTQNWNRVEAGNSYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGSLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 19678 - protein, 1308 aa, Homo sapiens
  Payload ID: 3941
  Gene Symbol: CNTNAP4
  Gene Name: contactin associated protein-like 4
  Uniprot ID: Q9C0A0
  ENSP ID: ENSP00000479811
MGSVTGAVLKTLLLLSTQNWNRVEAGNSYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEISFGGIPAPGKSVSFPHRNFHGCLENLYYNGVDIIDLAKQQKPQIIAMGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGSLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 19679 - protein, 1306 aa, Homo sapiens
  Payload ID: 3942
  Gene Symbol: CNTNAP5
  Gene Name: contactin associated protein-like 5
  Uniprot ID: Q8WYK1
  ENSP ID: ENSP00000399013
MDSLPRLTSVLTLLFSGLWHLGLTATNYNCDDPLASLLSPMAFSSSSDLTGTHSPAQLNWRVGTGGWSPADSNAQQWLQMDLGNRVEITAVATQGRYGSSDWVTSYSLMFSDTGRNWKQYKQEDSIWTFAGNMNADSVVHHKLLHSVRARFVRFVPLEWNPSGKIGMRVEVYGCSYKSDVADFDGRSSLLYRFNQKLMSTLKDVISLKFKSMQGDGVLFHGEGQRGDHITLELQKGRLALHLNLGDSKARLSSSLPSATLGSLLDDQHWHSVLIERVGKQVNFTVDKHTQHFRTKGETDALDIDYELSFGGIPVPGKPGTFLKKNFHGCIENLYYNGVNIIDLAKRRKHQIYTGNVTFSCSEPQIVPITFVNSSGSYLLLPGTPQIDGLSVSFQFRTWNKDGLLLSTELSEGSGTLLLSLEGGILRLVIQKMTERVAEILTGSNLNDGLWHSVSINARRNRITLTLDDEAAPPAPDSTWVQIYSGNSYYFGGCPDNLTDSQCLNPIKAFQGCMRLIFIDNQPKDLISVQQGSLGNFSDLHIDLCSIKDRCLPNYCEHGGSCSQSWTTFYCNCSDTSYTGATCHNSIYEQSCEVYRHQGNTAGFFYIDSDGSGPLGPLQVYCNITEDKIWTSVQHNNTELTRVRGANPEKPYAMALDYGGSMEQLEAVIDGSEHCEQEVAYHCRRSRLLNTPDGTPFTWWIGRSNERHPYWGGSPPGVQQCECGLDESCLDIQHFCNCDADKDEWTNDTGFLSFKDHLPVTQIVITDTDRSNSEAAWRIGPLRCYGDRRFWNAVSFYTEASYLHFPTFHAEFSADISFFFKTTALSGVFLENLGIKDFIRLEISSPSEITFAIDVGNGPVELVVQSPSLLNDNQWHYVRAERNLKETSLQVDNLPRSTRETSEEGHFRLQLNSQLFVGGTSSRQKGFLGCIRSLHLNGQKMDLEERAKVTSGVRPGCPGHCSSYGSICHNGGKCVEKHNGYLCDCTNSPYEGPFCKKEVSAVFEAGTSVTYMFQEPYPVTKNISLSSSAIYTDSAPSKENIALSFVTTQAPSLLLFINSSSQDFVVVLLCKNGSLQVRYHLNKEETHVFTIDADNFANRRMHHLKINREGRELTIQMDQQLRLSYNFSPEVEFRVIRSLTLGKVTENLGLDSEVAKANAMGFAGCMSSVQYNHIAPLKAALRHATVAPVTVHGTLTESSCGFMVDSDVNAVTTVHSSSDPFGKTDEREPLTNAVRSDSAVIGGVIAVVIFIIFCIIGIMTRFLYQHKQSHRTSQMKEKEYPENLDSSFRNEIDLQNTVSECKREYFI

SEQ ID NO: 19680 - protein, 184 aa, Homo sapiens
  Payload ID: 3943
  Gene Symbol: COPRS
  Gene Name: coordinator of PRMT5, differentiation stimulator
  Uniprot ID: Q9NQ92
  ENSP ID: ENSP00000304327
MDLQAAGAQAQGAAEPSRGPPLPSARGAPPSPEAGFATADHSSQERETEKAMDRLARGTQSIPNDSPARGEGTHSEEEGFAMDEEDSDGELNTWELSEGTNCPPKEQPGDLFNEDWDSELKADQGNPYDADDIQESISQELKPWVCCAPQGDMIYDPSWHHPPPLIPYYSKMVFETGQFDDAED

SEQ ID NO: 19681 - protein, 172 aa, Homo sapiens
  Payload ID: 3943
  Gene Symbol: COPRS
  Gene Name: coordinator of PRMT5, differentiation stimulator
  ENSP ID: ENSP00000367901
MGGDAGDREPGPAARSLGEGQAGFATADHSSQERETEKAMDRLARGTQSIPNDSPARGEGTHSEEEGFAMDEEDSDGELNTWELSEGTNCPPKEQPGDLFNEDWDSELKADQGNPYDADDIQESISQELKPWVCCAPQGDMIYDPSWHHPPPLIPYYSKMVFETGQFDDAED

SEQ ID NO: 19682 - protein, 82 aa, Homo sapiens
  Payload ID: 3943
  Gene Symbol: COPRS
  Gene Name: coordinator of PRMT5, differentiation stimulator
  ENSP ID: ENSP00000464423
MDLQAAGAQAQGAAEPSRGPPLPSARGAPPSPEAGFATADHSSQERETEKAMDRLASPLCCLVAFSAQLNSNLLWKPCLELP

SEQ ID NO: 19683 - protein, 103 aa, Homo sapiens
  Payload ID: 3943
  Gene Symbol: COPRS
  Gene Name: coordinator of PRMT5, differentiation stimulator
  ENSP ID: ENSP00000464425
MDRLARGTQSIPNDSPARGEGTHSEEEGFAMDEEDSDGELNTWELSEGTNCPPKEQPGDLFNEDWDSELKADQGNPYDADDIQESISQELKPWVCCAPQGDMI

SEQ ID NO: 19684 - protein, 68 aa, Homo sapiens
  Payload ID: 3943
  Gene Symbol: COPRS
  Gene Name: coordinator of PRMT5, differentiation stimulator
  ENSP ID: ENSP00000464429
MDLQAAGAQAQGAAEPSRGPPLPSARGAPPSPEPVEHRAFLMTVLPGVRAPILKRKALPWMRRTLMEN

SEQ ID NO: 19685 - protein, 450 aa, Homo sapiens
  Payload ID: 3944
  Gene Symbol: COPS2
  Gene Name: COP9 signalosome subunit 2
  Uniprot ID: P61201
  ENSP ID: ENSP00000299259
MSDMEDDFMCDDEEDYDLEYSEDSNSEPNVDLENQYYNSKALKEDDPKAALSSFQKVLELEGEKGEWGFKALKQMIKINFKLTNFPEMMNRYKQLLTYIRSAVTRNYSEKSINSILDYISTSKQNSDFLCQMDLLQEFYETTLEALKDAKNDRLWFKTNTKLGKLYLEREEYGKLQKILRQLHQSCQTDDGEDDLKKGTQLLEIYALEIQMYTAQKNNKKLKALYEQSLHIKSAIPHPLIMGVIRECGGKMHLREGEFEKAHTDFFEAFKNYDESGSPRRTTCLKYLVLANMLMKSGINPFDSQEAKPYKNDPEILAMTNLVSAYQNNDITEFEKILKTNHSNIMDDPFIREHIEELLRNIRTQVLIKLIKPYTRIHIPFISKELNIDVADVESLLVQCILDNTIHGRIDQVNQLLELDHQKRGGARYTALDKWTNQLNSLNQAVVSKLA

SEQ ID NO: 19686 - protein, 443 aa, Homo sapiens
  Payload ID: 3944
  Gene Symbol: COPS2
  Gene Name: COP9 signalosome subunit 2
  Uniprot ID: P61201
  ENSP ID: ENSP00000373553
MSDMEDDFMCDDEEDYDLEYSEDSNSEPNVDLENQYYNSKALKEDDPKAALSSFQKVLELEGEKGEWGFKALKQMIKINFKLTNFPEMMNRYKQLLTYIRSAVTRNYSEKSINSILDYISTSKQMDLLQEFYETTLEALKDAKNDRLWFKTNTKLGKLYLEREEYGKLQKILRQLHQSCQTDDGEDDLKKGTQLLEIYALEIQMYTAQKNNKKLKALYEQSLHIKSAIPHPLIMGVIRECGGKMHLREGEFEKAHTDFFEAFKNYDESGSPRRTTCLKYLVLANMLMKSGINPFDSQEAKPYKNDPEILAMTNLVSAYQNNDITEFEKILKTNHSNIMDDPFIREHIEELLRNIRTQVLIKLIKPYTRIHIPFISKELNIDVADVESLLVQCILDNTIHGRIDQVNQLLELDHQKRGGARYTALDKWTNQLNSLNQAVVSKLA

SEQ ID NO: 19687 - protein, 379 aa, Homo sapiens
  Payload ID: 3944
  Gene Symbol: COPS2
  Gene Name: COP9 signalosome subunit 2
  ENSP ID: ENSP00000443664
MSDMEDDFMCDDEEDYDLTNFPEMMNRYKQLLTYIRSAVTRNYSEKSINSILDYISTSKQMDLLQEFYETTLEALKDAKNDRLWFKTNTKLGKLYLEREEYGKLQKILRQLHQSCQTDDGEDDLKKGTQLLEIYALEIQMYTAQKNNKKLKALYEQSLHIKSAIPHPLIMGVIRECGGKMHLREGEFEKAHTDFFEAFKNYDESGSPRRTTCLKYLVLANMLMKSGINPFDSQEAKPYKNDPEILAMTNLVSAYQNNDITEFEKILKTNHSNIMDDPFIREHIEELLRNIRTQVLIKLIKPYTRIHIPFISKELNIDVADVESLLVQCILDNTIHGRIDQVNQLLELDHQKRGGARYTALDKWTNQLNSLNQAVVSKLA

SEQ ID NO: 19688 - protein, 263 aa, Homo sapiens
  Payload ID: 3944
  Gene Symbol: COPS2
  Gene Name: COP9 signalosome subunit 2
  ENSP ID: ENSP00000452944
MSDMEDDFMCDDEEDYDLEYSEDSNSEPNVDLENQYYNSKALKEDDPKAALSSFQKVLELEGEKGEWGFKALKQMIKINFKLTNFPEMMNRYKQLLTYIRSAVTRNYSEKSINSILDYISTSKQMDLLQEFYETTLEALKDAKNDRLWFKTNTKLGKLYLEREEYGKLQKILRQLHQSCQTDDGEDDLKKGTQLLEIYALEIQMYTAQKNNKKLKALYEQSLHIKSAIPHPLIMGVIRECGGKMHLREGEFEKAHTDFFEAFK

SEQ ID NO: 19689 - protein, 183 aa, Homo sapiens
  Payload ID: 3944
  Gene Symbol: COPS2
  Gene Name: COP9 signalosome subunit 2
  ENSP ID: ENSP00000453412
MSDMEDDFMCDDEEDYDLTNFPEMMNRYKQLLTYIRSAVTRNYSEKSINSILDYISTSKQMDLLQEFYETTLEALKDAKNDRLWFKTNTKLGKLYLEREEYGKLQKILRQLHQSCQTDDGEDDLKKGTQLLEIYALEIQMYTAQKNNKKLKALYEQSLHIKSAIPHPLIMGVIRECGGKMHLR

SEQ ID NO: 19690 - protein, 55 aa, Homo sapiens
  Payload ID: 3944
  Gene Symbol: COPS2
  Gene Name: COP9 signalosome subunit 2
  ENSP ID: ENSP00000453546
KTNHSNIMDDPFIREHIEELLRNIRTQVLIKLIKPYTRIHIPFISKMESRSCCLG

SEQ ID NO: 19691 - protein, 423 aa, Homo sapiens
  Payload ID: 3945
  Gene Symbol: COPS3
  Gene Name: COP9 signalosome subunit 3
  Uniprot ID: Q9UNS2
  ENSP ID: ENSP00000268717
MASALEQFVNSVRQLSAQGQMTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKPLSNAYHELAQVYSTNNPSELRNLVNKHSETFTRDNNMGLVKQCLSSLYKKNIQRLTKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 19692 - protein, 318 aa, Homo sapiens
  Payload ID: 3945
  Gene Symbol: COPS3
  Gene Name: COP9 signalosome subunit 3
  ENSP ID: ENSP00000409028
MASALEQFVNSVRQLSAQGQMTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKRQSLAMLARLVLNSWPQAVLLRLPPRVLGLQPLSNAYHELAQVYSTNNPSELRNLVNKHSETFT

SEQ ID NO: 19693 - protein, 345 aa, Homo sapiens
  Payload ID: 3945
  Gene Symbol: COPS3
  Gene Name: COP9 signalosome subunit 3
  ENSP ID: ENSP00000413298
MTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 19694 - protein, 403 aa, Homo sapiens
  Payload ID: 3945
  Gene Symbol: COPS3
  Gene Name: COP9 signalosome subunit 3
  Uniprot ID: Q9UNS2
  ENSP ID: ENSP00000437606
MTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKPLSNAYHELAQVYSTNNPSELRNLVNKHSETFTRDNNMGLVKQCLSSLYKKNIQRLTKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 19695 - protein, 107 aa, Homo sapiens
  Payload ID: 3945
  Gene Symbol: COPS3
  Gene Name: COP9 signalosome subunit 3
  ENSP ID: ENSP00000463098
MASALEQFVNSVRQLSAQGQMTQLCELINKSGELLAKNLSHLDTVLGALDVQEHSLGVLAVLFVKFSMPSVPDFETLFSQVQLFISTCNGEHIRYATDTSPARNWHP

SEQ ID NO: 19696 - protein, 116 aa, Homo sapiens
  Payload ID: 3945
  Gene Symbol: COPS3
  Gene Name: COP9 signalosome subunit 3
  ENSP ID: ENSP00000463195
MASALEQFVNSVRQLSAQGQMTQLCELINKSGELLAKNLSHLDTVLGALDVQEHSLGVLAVLFVKFSMPSVPDFETLFSQVQLFISTCNGEHIRYATDTFAGLCHQLTNALVERKQ

SEQ ID NO: 19697 - protein, 20 aa, Homo sapiens
  Payload ID: 3945
  Gene Symbol: COPS3
  Gene Name: COP9 signalosome subunit 3
  ENSP ID: ENSP00000463340
MASALEQFVNSVRQLSAQGL

SEQ ID NO: 19698 - protein, 31 aa, Homo sapiens
  Payload ID: 3945
  Gene Symbol: COPS3
  Gene Name: COP9 signalosome subunit 3
  ENSP ID: ENSP00000463477
MASALEQFVNSVRQLSAQVLFLFSRANDTAL

SEQ ID NO: 19699 - protein, 20 aa, Homo sapiens
  Payload ID: 3945
  Gene Symbol: COPS3
  Gene Name: COP9 signalosome subunit 3
  ENSP ID: ENSP00000464369
MASALEQFVNSVRQLSAQGL

SEQ ID NO: 19700 - protein, 31 aa, Homo sapiens; identical to SEQ ID NO: 19698
  Payload ID: 3945
  Gene Symbol: COPS3
  Gene Name: COP9 signalosome subunit 3
  ENSP ID: ENSP00000464572

SEQ ID NO: 19701 - protein, 17 aa, Homo sapiens
  Payload ID: 3945
  Gene Symbol: COPS3
  Gene Name: COP9 signalosome subunit 3
  ENSP ID: ENSP00000465156
  MOD_RES (1)..(1): Any amino acid
XAGLCHQLTNALVERKQ

SEQ ID NO: 19702 - protein, 51 aa, Homo sapiens
  Payload ID: 3945
  Gene Symbol: COPS3
  Gene Name: COP9 signalosome subunit 3
  ENSP ID: ENSP00000466153
EIFASINQKDGMVSFHDNPEKYNNPAMLHNIDQESMGSQEDDSGNKPSSYS

SEQ ID NO: 19703 - protein, 122 aa, Homo sapiens
  Payload ID: 3945
  Gene Symbol: COPS3
  Gene Name: COP9 signalosome subunit 3
  ENSP ID: ENSP00000468536
  MOD_RES (1)..(1): Any amino acid
XFETLFSQVQLFISTCNGEHIRYATDTFAGLCHQLTNALVERKQPLRGIGILKQAIDKMQMNTNQLTSIHADLCQAITTPAMAVSHIMLESYKKYILVSLILLGKVQQLPKYTSQIVGRFIK

SEQ ID NO: 19704 - protein, 406 aa, Homo sapiens
  Payload ID: 3946
  Gene Symbol: COPS4
  Gene Name: COP9 signalosome subunit 4
  Uniprot ID: Q9BT78
  ENSP ID: ENSP00000264389
MAAAVRQDLAQLMNSSGSHKDLAGKYRQILEKAIQLSGAEQLEALKAFVEAMVNENVSLVISRQLLTDFCTHLPNLPDSTAKEIYHFTLEKIQPRVISFEEQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 19705 - protein, 420 aa, Homo sapiens
  Payload ID: 3946
  Gene Symbol: COPS4
  Gene Name: COP9 signalosome subunit 4
  ENSP ID: ENSP00000424655
MAAAVRQDLAQLMNSSGSHKDLAGKYRQILEKAIQLSGAEQLEALKAFVEAMVNENVSLVISRQLLTDFCTHLPNLPDSTAKEIYHFTLEKIQPRVISFEEQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKAEKIASQMITEGRMNGFIDQIDGIVHFETSGNHQSIFCLWIYLVWIVHINGIIQYVTCDLLADSTQHSIFRVHPCHGSTRSPANVG

SEQ ID NO: 19706 - protein, 438 aa, Homo sapiens
  Payload ID: 3946
  Gene Symbol: COPS4
  Gene Name: COP9 signalosome subunit 4
  ENSP ID: ENSP00000424791
MAAAVRQDLAQLMNSSGSHKDLAGKYRQILEKAIQLSGAEQLEALKAFVEAMVNENVSLVISRQLLTDFCTHLPNLPDSTAKEIYHFTLEKIQPRVISFEEQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADETGSLHFAQAGLELLGSSSSSHLGFPKCWDDRGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 19707 - protein, 275 aa, Homo sapiens
  Payload ID: 3946
  Gene Symbol: COPS4
  Gene Name: COP9 signalosome subunit 4
  ENSP ID: ENSP00000425486
MAAAVRQDLAQLMNSSGSHKDLAGKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKAEKIASQMITEGRMNGFIDQIDGIVHFETREALPTWDKQIQSLCFQVNNLLEK

SEQ ID NO: 19708 - protein, 352 aa, Homo sapiens
  Payload ID: 3946
  Gene Symbol: COPS4
  Gene Name: COP9 signalosome subunit 4
  Uniprot ID: Q9BT78
  ENSP ID: ENSP00000425976
MAAAVRQDLAQLMNSSGSHKDLAGKYRQILEKAIQLSGAEQLEALKAFVEAMVNENVSLVISRQLLTDFCTHLPNLPDSTAKEIYHFTLEKIQPRVISFEEQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKHEKPCQRGISRSNHFVSK

SEQ ID NO: 19709 - protein, 51 aa, Homo sapiens
  Payload ID: 3946
  Gene Symbol: COPS4
  Gene Name: COP9 signalosome subunit 4
  ENSP ID: ENSP00000426788
MAAAVRQDLAQLMNSSGSHKDLAGKTLFSFGIVVGIVRSWKKPFSYLEQNN

SEQ ID NO: 19710 - protein, 334 aa, Homo sapiens
  Payload ID: 3947
  Gene Symbol: COPS5
  Gene Name: COP9 signalosome subunit 5
  Uniprot ID: Q92905
  ENSP ID: ENSP00000350512
MAASGSGMAQKTWELANNMQEAQSIDEIYKYDKKQQQEILAAKPWTKDHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTNADYTTGQVFDLSEKLEQSEAQLGRGSFMLGLETHDRKSEDKLAKATRDSCKTTIEAIHGLMSQVIKDKLFNQINIS

SEQ ID NO: 19711 - protein, 68 aa, Homo sapiens
  Payload ID: 3947
  Gene Symbol: COPS5
  Gene Name: COP9 signalosome subunit 5
  ENSP ID: ENSP00000427869
MAASGSGMAQKTWELANNMQEAQSIDEIYKYDKKQQQEILAAKPWTKDKGRSQDFDSCLDFQHESPLL

SEQ ID NO: 19712 - protein, 57 aa, Homo sapiens
  Payload ID: 3947
  Gene Symbol: COPS5
  Gene Name: COP9 signalosome subunit 5
  ENSP ID: ENSP00000427997
MAASGSGMAQKTWELANNMQEAQSIDEIYKYDKKQQQEILAAKPWTKENGSSLCCSG

SEQ ID NO: 19713 - protein, 78 aa, Homo sapiens
  Payload ID: 3947
  Gene Symbol: COPS5
  Gene Name: COP9 signalosome subunit 5
  ENSP ID: ENSP00000428124
MAASGSGMAQKTWELANNMQEAQSIDEIYKYDKKQQQEILAAKPWTKDKGRSQDFDSCLDFQHEVYTFFSFWLKSGKA

SEQ ID NO: 19714 - protein, 151 aa, Homo sapiens
  Payload ID: 3947
  Gene Symbol: COPS5
  Gene Name: COP9 signalosome subunit 5
  ENSP ID: ENSP00000428586
MVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFG

SEQ ID NO: 19715 - protein, 197 aa, Homo sapiens
  Payload ID: 3947
  Gene Symbol: COPS5
  Gene Name: COP9 signalosome subunit 5
  ENSP ID: ENSP00000429774
MVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTRQVY

SEQ ID NO: 19716 - protein, 327 aa, Homo sapiens
  Payload ID: 3948
  Gene Symbol: COPS6
  Gene Name: COP9 signalosome subunit 6
  Uniprot ID: Q7L5N1
  ENSP ID: ENSP00000304102
MAAAAAAAAATNGTGGSSGMEVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 19717 - protein, 41 aa, Homo sapiens
  Payload ID: 3948
  Gene Symbol: COPS6
  Gene Name: COP9 signalosome subunit 6
  ENSP ID: ENSP00000388865
MACGVTGSVSVALHPLVILNISDHWIRMRSQEGRPVQVIGA

SEQ ID NO: 19718 - protein, 326 aa, Homo sapiens
  Payload ID: 3948
  Gene Symbol: COPS6
  Gene Name: COP9 signalosome subunit 6
  ENSP ID: ENSP00000400617
MAAAAAAAAATNGTGGSSGMEVDAAVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 19719 - protein, 123 aa, Homo sapiens
  Payload ID: 3948
  Gene Symbol: COPS6
  Gene Name: COP9 signalosome subunit 6
  ENSP ID: ENSP00000413702
LGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILERGPL

SEQ ID NO: 19720 - protein, 275 aa, Homo sapiens
  Payload ID: 3949
  Gene Symbol: COPS7A
  Gene Name: COP9 signalosome subunit 7A
  Uniprot ID: Q9UBW8
  ENSP ID: ENSP00000229251
MSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQVSRANQHKEQQLGLKQQIESEVANLKKTIKVTTAAAAAATSQDPEQHLTELREPAPGTNQRQPSKKASKGKGLRGSAKIWSKSN

SEQ ID NO: 19721 - protein, 62 aa, Homo sapiens
  Payload ID: 3949
  Gene Symbol: COPS7A
  Gene Name: COP9 signalosome subunit 7A
  ENSP ID: ENSP00000387787
MSAEVKVTGQNQEQFLLLAKSAKGAALATLIHQVLEAPGVYVFGELLDMPNVRELKPGIFLH

SEQ ID NO: 19722 - protein, 275 aa, Homo sapiens; identical to SEQ ID NO: 19720
  Payload ID: 3949
  Gene Symbol: COPS7A
  Gene Name: COP9 signalosome subunit 7A
  Uniprot ID: Q9UBW8
  ENSP ID: ENSP00000438115

SEQ ID NO: 19723 - protein, 62 aa, Homo sapiens; identical to SEQ ID NO: 19721
  Payload ID: 3949
  Gene Symbol: COPS7A
  Gene Name: COP9 signalosome subunit 7A
  ENSP ID: ENSP00000438352

SEQ ID NO: 19724 - protein, 275 aa, Homo sapiens; identical to SEQ ID NO: 19720
  Payload ID: 3949
  Gene Symbol: COPS7A
  Gene Name: COP9 signalosome subunit 7A
  Uniprot ID: Q9UBW8
  ENSP ID: ENSP00000438363

SEQ ID NO: 19725 - protein, 62 aa, Homo sapiens; identical to SEQ ID NO: 19721
  Payload ID: 3949
  Gene Symbol: COPS7A
  Gene Name: COP9 signalosome subunit 7A
  ENSP ID: ENSP00000438571

SEQ ID NO: 19726 - protein, 62 aa, Homo sapiens; identical to SEQ ID NO: 19721
  Payload ID: 3949
  Gene Symbol: COPS7A
  Gene Name: COP9 signalosome subunit 7A
  ENSP ID: ENSP00000439158

SEQ ID NO: 19727 - protein, 262 aa, Homo sapiens
  Payload ID: 3949
  Gene Symbol: COPS7A
  Gene Name: COP9 signalosome subunit 7A
  ENSP ID: ENSP00000439547
MSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQVSRANQHKEQQLGLKQQIESEAPRERQDLVQVELKGLSFPPWGCGVPAACLPLRSPQRAFCAPGQLIILGS

SEQ ID NO: 19728 - protein, 125 aa, Homo sapiens
  Payload ID: 3949
  Gene Symbol: COPS7A
  Gene Name: COP9 signalosome subunit 7A
  ENSP ID: ENSP00000439949
MSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKCIPYAVLLEALALRNV

SEQ ID NO: 19729 - protein, 62 aa, Homo sapiens; identical to SEQ ID NO: 19721
  Payload ID: 3949
  Gene Symbol: COPS7A
  Gene Name: COP9 signalosome subunit 7A
  ENSP ID: ENSP00000440020

SEQ ID NO: 19730 - protein, 212 aa, Homo sapiens
  Payload ID: 3949
  Gene Symbol: COPS7A
  Gene Name: COP9 signalosome subunit 7A
  ENSP ID: ENSP00000440683
MSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQVSRANQHKEQQLGLKQQIESE

SEQ ID NO: 19731 - protein, 71 aa, Homo sapiens
  Payload ID: 3949
  Gene Symbol: COPS7A
  Gene Name: COP9 signalosome subunit 7A
  ENSP ID: ENSP00000440972
MSAEVKVTGQNQEQFLLLAKSAKGAALATLIHQVLEAPGVYVFGELLDMPNVREGRNWMTYGARGHCGLGE

SEQ ID NO: 19732 - protein, 275 aa, Homo sapiens; identical to SEQ ID NO: 19720
  Payload ID: 3949
  Gene Symbol: COPS7A
  Gene Name: COP9 signalosome subunit 7A
  Uniprot ID: Q9UBW8
  ENSP ID: ENSP00000441852

SEQ ID NO: 19733 - protein, 192 aa, Homo sapiens
  Payload ID: 3949
  Gene Symbol: COPS7A
  Gene Name: COP9 signalosome subunit 7A
  ENSP ID: ENSP00000442613
MSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQV

SEQ ID NO: 19734 - protein, 62 aa, Homo sapiens; identical to SEQ ID NO: 19721
  Payload ID: 3949
  Gene Symbol: COPS7A
  Gene Name: COP9 signalosome subunit 7A
  ENSP ID: ENSP00000443628

SEQ ID NO: 19735 - protein, 56 aa, Homo sapiens
  Payload ID: 3949
  Gene Symbol: COPS7A
  Gene Name: COP9 signalosome subunit 7A
  ENSP ID: ENSP00000444807
MSAEVKVTGQNQEQFLLLAKSAKGAALATLIHQVLEAPGVYVFGELLDMPNVREWN

SEQ ID NO: 19736 - protein, 60 aa, Homo sapiens
  Payload ID: 3949
  Gene Symbol: COPS7A
  Gene Name: COP9 signalosome subunit 7A
  ENSP ID: ENSP00000445300
MSAEVKVTGQNQEQFLLLAKSAKGAALATLIHQVLEAPGVYVFGELLDMPNVRERHMANC

SEQ ID NO: 19737 - protein, 275 aa, Homo sapiens; identical to SEQ ID NO: 19720
  Payload ID: 3949
  Gene Symbol: COPS7A
  Gene Name: COP9 signalosome subunit 7A
  Uniprot ID: Q9UBW8
  ENSP ID: ENSP00000446039

SEQ ID NO: 19738 - protein, 62 aa, Homo sapiens; identical to SEQ ID NO: 19721
  Payload ID: 3949
  Gene Symbol: COPS7A
  Gene Name: COP9 signalosome subunit 7A
  ENSP ID: ENSP00000473363

SEQ ID NO: 19739 - protein, 62 aa, Homo sapiens; identical to SEQ ID NO: 19721
  Payload ID: 3949
  Gene Symbol: COPS7A
  Gene Name: COP9 signalosome subunit 7A
  ENSP ID: ENSP00000487362

SEQ ID NO: 19740 - protein, 264 aa, Homo sapiens
  Payload ID: 3950
  Gene Symbol: COPS7B
  Gene Name: COP9 signalosome subunit 7B
  Uniprot ID: Q9H9Q2
  ENSP ID: ENSP00000272995
MAGEQKPSSNLLEQFILLAKGTSGSALTALISQVLEAPGVYVFGELLELANVQELAEGANAAYLQLLNLFAYGTYPDYIANKESLPELSTAQQNKLKHLTIVSLASRMKCIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEVTNIKKTLKATASSSAQEMEQQLAERECPPHAEQRQPTKKMSKVKGLVSSRH

SEQ ID NO: 19741 - protein, 273 aa, Homo sapiens
  Payload ID: 3950
  Gene Symbol: COPS7B
  Gene Name: COP9 signalosome subunit 7B
  Uniprot ID: Q9H9Q2
  ENSP ID: ENSP00000362710
MAGEQKPSSNLLEQFILLAKGTSGSALTALISQVLEAPGVYVFGELLELANVQELAEGANAAYLQLLNLFAYGTYPDYIANKESLPELSTAQQNKLKHLTIVSLASRMKCIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEREKRDVPLLNLITTAFFWLPTSRRHSKPPHPPRLRRWSSSWLNGSVPLTLSRGSPPRRCPK

SEQ ID NO: 19742 - protein, 230 aa, Homo sapiens
  Payload ID: 3950
  Gene Symbol: COPS7B
  Gene Name: COP9 signalosome subunit 7B
  ENSP ID: ENSP00000386438
MTARRELTSVYMELRHLQIMLAEGANAAYLQLLNLFAYGTYPDYIANKESLPELSTAQQNKLKHLTIVSLASRMKCIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEVTNIKKTLKATASSSAQEMEQQLAERECPPHAEQRQPTKKMSKVKGLVSSRH

SEQ ID NO: 19743 - protein, 157 aa, Homo sapiens
  Payload ID: 3950
  Gene Symbol: COPS7B
  Gene Name: COP9 signalosome subunit 7B
  Uniprot ID: Q9H9Q2
  ENSP ID: ENSP00000386527
MKCIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEVTNIKKTLKATASSSAQEMEQQLAERECPPHAEQRQPTKKMSKVKGLVSSRH

SEQ ID NO: 19744 - protein, 264 aa, Homo sapiens; identical to SEQ ID NO: 19740
  Payload ID: 3950
  Gene Symbol: COPS7B
  Gene Name: COP9 signalosome subunit 7B
  Uniprot ID: Q9H9Q2
  ENSP ID: ENSP00000386567

SEQ ID NO: 19745 - protein, 278 aa, Homo sapiens
  Payload ID: 3950
  Gene Symbol: COPS7B
  Gene Name: COP9 signalosome subunit 7B
  ENSP ID: ENSP00000386880
MAGEQKPSSNLLEQFILLAKGTSGSALTALISQVLEAPGVYVFGELLELANVQELAEGANAAYLQLLNLFAYGTYPDYIANKESLPELSTAQQNKLKHLTIVSLASRMKCIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEIACFQREKRDVPLLNLITTAFFWLPTSRRHSKPPHPPRLRRWSSSWLNGSVPLTLSRGSPPRRCPK

SEQ ID NO: 19746 - protein, 103 aa, Homo sapiens
  Payload ID: 3950
  Gene Symbol: COPS7B
  Gene Name: COP9 signalosome subunit 7B
  ENSP ID: ENSP00000388499
MAGEQKPSSNLLEQFILLAKGTSGSALTALISQVLEAPGVYVFGELLELANVQELAEGANAAYLQLLNLFAYGTYPDYIVYPLLRVAERPGDAESPGTRRPYH

SEQ ID NO: 19747 - protein, 78 aa, Homo sapiens
  Payload ID: 3950
  Gene Symbol: COPS7B
  Gene Name: COP9 signalosome subunit 7B
  ENSP ID: ENSP00000391207
MAGEQKPSSNLLEQFILLAKGTSGSALTALISQVLEAPGVYVFGELLELANVQEPGWSRSPDLMIHPPRPPKVLGLQA

SEQ ID NO: 19748 - protein, 49 aa, Homo sapiens
  Payload ID: 3950
  Gene Symbol: COPS7B
  Gene Name: COP9 signalosome subunit 7B
  ENSP ID: ENSP00000400739
  MOD_RES (1)..(1): Any amino acid
XYVFGELLELANVQELAEGANAAYLQLLNLFAYGTYPDYIDEILEDWCL

SEQ ID NO: 19749 - protein, 62 aa, Homo sapiens
  Payload ID: 3950
  Gene Symbol: COPS7B
  Gene Name: COP9 signalosome subunit 7B
  ENSP ID: ENSP00000401110
MAGEQKPSSNLLEQFILLAKGTSGSALTALISQVLEAPGVYVFGELLELANVQEDGLDLLTS

SEQ ID NO: 19750 - protein, 62 aa, Homo sapiens
  Payload ID: 3950
  Gene Symbol: COPS7B
  Gene Name: COP9 signalosome subunit 7B
  ENSP ID: ENSP00000401211
MAGEQKPSSNLLEQFILLAKGTSGSALTALISQVLEAPGVYVFGELLELANVQEPTRRACQN

SEQ ID NO: 19751 - protein, 54 aa, Homo sapiens
  Payload ID: 3950
  Gene Symbol: COPS7B
  Gene Name: COP9 signalosome subunit 7B
  ENSP ID: ENSP00000401235
MAGEQKPSSNLLEQFILLAKGTSGSALTALISQVLEAPGVYVFGELLELANVQE

SEQ ID NO: 19752 - protein, 68 aa, Homo sapiens
  Payload ID: 3950
  Gene Symbol: COPS7B
  Gene Name: COP9 signalosome subunit 7B
  ENSP ID: ENSP00000401682
MAGEQKPSSNLLEQFILLAKGTSGSALTALISQVLEAPGVYVFGELLELANVQERRGFTLLARMVSIS

SEQ ID NO: 19753 - protein, 172 aa, Homo sapiens
  Payload ID: 3950
  Gene Symbol: COPS7B
  Gene Name: COP9 signalosome subunit 7B
  ENSP ID: ENSP00000403300
YTDIIQGKLDQRNQLLEVDFCIGRDIRKKDINNIVKTLHEWCDGCEAVLLGIEQQVLRANQYKENHNRTQQQVEAEVTNIKKTLKATASSSAQEMEQQLAERECPPHAEQRQPTKKMSKVKGPSCPLELPANACSPKIFNSSWLHLGRDGGIDAPLSAEGPVAASVFSPLLG

SEQ ID NO: 19754 - protein, 54 aa, Homo sapiens; identical to SEQ ID NO: 19751
  Payload ID: 3950
  Gene Symbol: COPS7B
  Gene Name: COP9 signalosome subunit 7B
  ENSP ID: ENSP00000409591

SEQ ID NO: 19755 - protein, 150 aa, Homo sapiens
  Payload ID: 3950
  Gene Symbol: COPS7B
  Gene Name: COP9 signalosome subunit 7B
  ENSP ID: ENSP00000412548
MAGEQKPSSNLLEQFILLAKGTSGSALTALISQVLEAPGVYVFGELLELANVQECIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRT

SEQ ID NO: 19756 - protein, 209 aa, Homo sapiens
  Payload ID: 3950
  Gene Symbol: COPS7B
  Gene Name: COP9 signalosome subunit 7B
  ENSP ID: ENSP00000484363
MAGEQKPSSNLLEQFILLAKGTSGSALTALISQVLEAPGVYVFGELLELANVQECIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEVTNIKKTLKATASSSAQEMEQQLAERECPPHAEQRQPTKKMSKVKGLVSSRH

SEQ ID NO: 19757 - protein, 157 aa, Homo sapiens; identical to SEQ ID NO: 19743
  Payload ID: 3950
  Gene Symbol: COPS7B
  Gene Name: COP9 signalosome subunit 7B
  Uniprot ID: Q9H9Q2
  ENSP ID: ENSP00000484579

SEQ ID NO: 19758 - protein, 62 aa, Homo sapiens; identical to SEQ ID NO: 19749
  Payload ID: 3950
  Gene Symbol: COPS7B
  Gene Name: COP9 signalosome subunit 7B
  ENSP ID: ENSP00000487385

SEQ ID NO: 19759 - protein, 209 aa, Homo sapiens
  Payload ID: 3951
  Gene Symbol: COPS8
  Gene Name: COP9 signalosome subunit 8
  Uniprot ID: Q99627
  ENSP ID: ENSP00000346340
MPVAVMAESAFSFKKLLDQCENQELEAPGGIATPPVYGQLLALYLLHNDMNNARYLWKRIPPAIKSANSELGGIWSVGQRIWQRDFPGIYTTINAHQWSETVQPIMEALRDATRRRAFALVSQAYTSIIADDFAAFVGLPVEEAVKGILEQGWQADSTTRMVLPRKPVAGALDVSFNKFIPLSEPAPVPPIPNEQQLARLTDYVAFLEN

SEQ ID NO: 19760 - protein, 160 aa, Homo sapiens
  Payload ID: 3951
  Gene Symbol: COPS8
  Gene Name: COP9 signalosome subunit 8
  Uniprot ID: Q99627
  ENSP ID: ENSP00000375865
MNNARYLWKRIPPAIKSANSELGGIWSVGQRIWQRDFPGIYTTINAHQWSETVQPIMEALRDATRRRAFALVSQAYTSIIADDFAAFVGLPVEEAVKGILEQGWQADSTTRMVLPRKPVAGALDVSFNKFIPLSEPAPVPPIPNEQQLARLTDYVAFLEN

SEQ ID NO: 19761 - protein, 173 aa, Homo sapiens
  Payload ID: 3951
  Gene Symbol: COPS8
  Gene Name: COP9 signalosome subunit 8
  ENSP ID: ENSP00000387212
MPVAVMAESAFSFKKLLDQCENQELEAPGGIATPPVYGQLLALYLLHNDMNNARYLWKRIPPAIKSANSELGGIWSVGQRIWQRDFPGIYTTINAHQWSETVQPIMEALRGILEQGWQADSTTRMVLPRKPVAGALDVSFNKFIPLSEPAPVPPIPNEQQLARLTDYVAFLEN

SEQ ID NO: 19762 - protein, 64 aa, Homo sapiens
  Payload ID: 3951
  Gene Symbol: COPS8
  Gene Name: COP9 signalosome subunit 8
  ENSP ID: ENSP00000388655
MPVAVMAESAFSFKKLLDQCENQELEAPGGIATPPVYGQLLALYLLHNDINFYDLYLLNFIYNQ

SEQ ID NO: 19763 - protein, 83 aa, Homo sapiens
  Payload ID: 3951
  Gene Symbol: COPS8
  Gene Name: COP9 signalosome subunit 8
  ENSP ID: ENSP00000413696
  MOD_RES (1)..(1): Any amino acid
XIIADDFAAFVGLPVEEAVKGILEQGWQADSTTRMVLPRKPVAGALDVSFNKFIPLSEPAPVPPIPNEQQLARLTDYVAFLEN

SEQ ID NO: 19764 - protein, 196 aa, Homo sapiens
  Payload ID: 3952
  Gene Symbol: CPNE9
  Gene Name: copine family member IX
  ENSP ID: ENSP00000273027
  MOD_RES (1)..(1): Any amino acid
XRTSSQYMRFLTLGRNVRRRNMSTQELTQLNFTVAIDFTASNGNPLQPTSLHYMSPYQLSAYAMALKAVGEIIQDYDSDKLFPAYGFGAKLPPEGRISHQFPLNNNDEDPNCAGIEGVLESYFQSLRTVQLYGPTYFAPVINQVARAAAKISDGSQYYVLLIITDGVISDMTQTKEAIVSASSLPMSIIIVGVGPA

SEQ ID NO: 19765 - protein, 503 aa, Homo sapiens
  Payload ID: 3952
  Gene Symbol: CPNE9
  Gene Name: copine family member IX
  Uniprot ID: Q8IYJ1
  ENSP ID: ENSP00000373342
MSLGGASERSVPATKIEITVSCRNLLDLDTFSKSDPMVVLYTQSRASQEWREFGRTEVIDNTLNPDFVRKFVLDYFFEEKQNLRFDVYNVDSKTNISKPKDFLGQAFLALGEVIGGQGSRVERTLTGVPGKKCGTILLTAEELSNCRDIATMQLCANKLDKKDFFGKSDPFLVFYRSNEDGTFTICHKTEVVKNTLNPVWQPFSIPVRALCNGDYDRTVKIDVYDWDRDGSHDFIGEFTTSYRELSKAQNQFTVYEVLNPRKKCKKKKYVNSGTVTLLSFSVDSEFTFVDYIKGGTQLNFTVAIDFTASNGNPLQPTSLHYMSPYQLSAYAMALKAVGEIIQDYDSDKLFPAYGFGAKLPPEGRISHQFPLNNNDEDPNCAGIEGVLESYFQSLRTVQLYGPTYFAPVINQVARAAAKISDGSQYYVLLIITDGVISDMTQTKEAIVSASSLPMSIIIVGVGPAMFEAMEELDGDDVRVSSRGRYAERDIVQEGCCSLGTSVV

SEQ ID NO: 19766 - protein, 553 aa, Homo sapiens
  Payload ID: 3952
  Gene Symbol: CPNE9
  Gene Name: copine family member IX
  Uniprot ID: Q8IYJ1
  ENSP ID: ENSP00000373343
MSLGGASERSVPATKIEITVSCRNLLDLDTFSKSDPMVVLYTQSRASQEWREFGRTEVIDNTLNPDFVRKFVLDYFFEEKQNLRFDVYNVDSKTNISKPKDFLGQAFLALGEVIGGQGSRVERTLTGVPGKKCGTILLTAEELSNCRDIATMQLCANKLDKKDFFGKSDPFLVFYRSNEDGTFTICHKTEVVKNTLNPVWQPFSIPVRALCNGDYDRTVKIDVYDWDRDGSHDFIGEFTTSYRELSKAQNQFTVYEVLNPRKKCKKKKYVNSGTVTLLSFSVDSEFTFVDYIKGGTQLNFTVAIDFTASNGNPLQPTSLHYMSPYQLSAYAMALKAVGEIIQDYDSDKLFPAYGFGAKLPPEGRISHQFPLNNNDEDPNCAGIEGVLESYFQSLRTVQLYGPTYFAPVINQVARAAAKISDGSQYYVLLIITDGVISDMTQTKEAIVSASSLPMSIIIVGVGPAMFEAMEELDGDDVRVSSRGRYAERDIVQFVPFRDYVDRSGNQVLSMARLAKDVLAEIPEQLLSYMRTRDIQPRPPPPANPSPIPAPEQP

SEQ ID NO: 19767 - protein, 503 aa, Homo sapiens [sequence omitted]

SEQ ID NO: 19768 - protein, 542 aa, Homo sapiens
  Payload ID: 3953
  Gene Symbol: CPNE1
  Gene Name: copine I
  ENSP ID: ENSP00000317257
MKMMHMAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPAQAPQA

SEQ ID NO: 19769 - protein, 537 aa, Homo sapiens
  Payload ID: 3953
  Gene Symbol: CPNE1
  Gene Name: copine I
  Uniprot ID: Q99829
  ENSP ID: ENSP00000336945
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPAQAPQA

SEQ ID NO: 19770 - protein, 481 aa, Homo sapiens
  Payload ID: 3953
  Gene Symbol: CPNE1
  Gene Name: copine I
  ENSP ID: ENSP00000380584
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVAPREALAQTVLAEVPTQLVSYFRAQGWAPLKPLPPSAKDPAQAPQA

SEQ ID NO: 19771 - protein, 537 aa, Homo sapiens; identical to SEQ ID NO: 19769
  Payload ID: 3953
  Gene Symbol: CPNE1
  Gene Name: copine I
  Uniprot ID: Q99829
  ENSP ID: ENSP00000380585

SEQ ID NO: 19772 - protein, 427 aa, Homo sapiens
  Payload ID: 3953
  Gene Symbol: CPNE1
  Gene Name: copine I
  ENSP ID: ENSP00000386067
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASDMNGLVPSNTSCCCC

SEQ ID NO: 19773 - protein, 231 aa, Homo sapiens
  Payload ID: 3953
  Gene Symbol: CPNE1
  Gene Name: copine I
  ENSP ID: ENSP00000387434
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSL

SEQ ID NO: 19774 - protein, 213 aa, Homo sapiens
  Payload ID: 3953
  Gene Symbol: CPNE1
  Gene Name: copine I
  ENSP ID: ENSP00000389662
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITDFLGKSDPFLEFFRQGDGKWHLVYRSEVIKNNLNPTWKRFSVPVQHFCGGNPSTPIQVQCSDYDSDGSHDLIGTFHTSLAQLQAV

SEQ ID NO: 19775 - protein, 137 aa, Homo sapiens
  Payload ID: 3953
  Gene Symbol: CPNE1
  Gene Name: copine I
  ENSP ID: ENSP00000390141
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITDFLGKSDPF

SEQ ID NO: 19776 - protein, 386 aa, Homo sapiens
  Payload ID: 3953
  Gene Symbol: CPNE1
  Gene Name: copine I
  ENSP ID: ENSP00000390626
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGT

SEQ ID NO: 19777 - protein, 152 aa, Homo sapiens
  Payload ID: 3953
  Gene Symbol: CPNE1
  Gene Name: copine I
  ENSP ID: ENSP00000391483
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKK

SEQ ID NO: 19778 - protein, 208 aa, Homo sapiens
  Payload ID: 3953
  Gene Symbol: CPNE1
  Gene Name: copine I
  ENSP ID: ENSP00000396069
  MOD_RES (1)..(1): Any amino acid
XNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNVSPSGGIGTDRARRSAHTTGLILQGPGLGPAQATSTLSQGSCTGPPGLGSLGGCGKSSILCPRGPSGPQPNPSHSPQC

SEQ ID NO: 19779 - protein, 174 aa, Homo sapiens
  Payload ID: 3953
  Gene Symbol: CPNE1
  Gene Name: copine I
  ENSP ID: ENSP00000397638
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHL

SEQ ID NO: 19780 - protein, 209 aa, Homo sapiens
  Payload ID: 3953
  Gene Symbol: CPNE1
  Gene Name: copine I
  ENSP ID: ENSP00000401915
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQ

SEQ ID NO: 19781 - protein, 304 aa, Homo sapiens
  Payload ID: 3953
  Gene Symbol: CPNE1
  Gene Name: copine I
  ENSP ID: ENSP00000404355
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDS

SEQ ID NO: 19782 - protein, 138 aa, Homo sapiens
  Payload ID: 3953
  Gene Symbol: CPNE1
  Gene Name: copine I
  ENSP ID: ENSP00000409305
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITSPLPRSQLRN

SEQ ID NO: 19783 - protein, 201 aa, Homo sapiens
  Payload ID: 3953
  Gene Symbol: CPNE1
  Gene Name: copine I
  ENSP ID: ENSP00000409794
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCG

SEQ ID NO: 19784 - protein, 136 aa, Homo sapiens
  Payload ID: 3953
  Gene Symbol: CPNE1
  Gene Name: copine I
  ENSP ID: ENSP00000409955
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKD

SEQ ID NO: 19785 - protein, 66 aa, Homo sapiens
  Payload ID: 3953
  Gene Symbol: CPNE1
  Gene Name: copine I
  ENSP ID: ENSP00000412806
MAHCVTLVQLSISCDHLIDKDIGSKSDPLCVLLQDVGGGSWAELGRTERVRNCSSPEFSKTLQLEY

SEQ ID NO: 19786 - protein, 533 aa, Homo sapiens
  Payload ID: 3953
  Gene Symbol: CPNE1
  Gene Name: copine I
  ENSP ID: ENSP00000415597
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPAQA

SEQ ID NO: 19787 - protein, 305 aa, Homo sapiens
  Payload ID: 3953
  Gene Symbol: CPNE1
  Gene Name: copine I
  ENSP ID: ENSP00000416962
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQD

SEQ ID NO: 19788 - protein, 548 aa, Homo sapiens
  Payload ID: 3954
  Gene Symbol: CPNE2
  Gene Name: copine II
  Uniprot ID: Q96FN4
  ENSP ID: ENSP00000290776
MAHIPSGGAPAAGAAPMGPQYCVCKVELSVSGQNLLDRDVTSKSDPFCVLFTENNGRWIEYDRTETAINNLNPAFSKKFVLDYHFEEVQKLKFALFDQDKSSMRLDEHDFLGQFSCSLGTIVSSKKITRPLLLLNDKPAGKGLITIAAQELSDNRVITLSLAGRRLDKKDLFGKSDPFLEFYKPGDDGKWMLVHRTEVIKYTLDPVWKPFTVPLVSLCDGDMEKPIQVMCYDYDNDGGHDFIGEFQTSVSQMCEARDSVPLEFECINPKKQRKKKNYKNSGIIILRSCKINRDYSFLDYILGGCQLMFTVGIDFTASNGNPLDPSSLHYINPMGTNEYLSAIWAVGQIIQDYDSDKMFPALGFGAQLPPDWKVSHEFAINFNPTNPFCSGVDGIAQAYSACLPHIRFYGPTNFSPIVNHVARFAAQATQQRTATQYFILLIITDGVISDMEETRHAVVQASKLPMSIIIVGVGNADFAAMEFLDGDSRMLRSHTGEEAARDIVQFVPFREFRNAAKETLAKAVLAELPQQVVQYFKHKNLPPTNSEPA

SEQ ID NO: 19789 - protein, 548 aa, Homo sapiens; identical to SEQ ID NO: 19788
  Payload ID: 3954
  Gene Symbol: CPNE2
  Gene Name: copine II
  Uniprot ID: Q96FN4
  ENSP ID: ENSP00000439018

SEQ ID NO: 19790 - protein, 121 aa, Homo sapiens
  Payload ID: 3954
  Gene Symbol: CPNE2
  Gene Name: copine II
  ENSP ID: ENSP00000455443
MRLDEHDFLGQFSCSLGTIVSSKKITRPLLLLNDKPAGKGLITIAAQELSDNRVITLSLAGRRLDKKDLFGKSDPFLEFYKPGDDGKWMLVHRTEVIKYTLDPVWKPFTVPLVSLCDGDME

SEQ ID NO: 19791 - protein, 81 aa, Homo sapiens
  Payload ID: 3954
  Gene Symbol: CPNE2
  Gene Name: copine II
  ENSP ID: ENSP00000455883
MAHIPSGGAPAAGAAPMGPQYCVCKVELSVSGQNLLDRDVTSKSDPFCVLFTENNGRWIEYDRTETAINNLNPAFSKKFVL

SEQ ID NO: 19792 - protein, 548 aa, Homo sapiens; identical to SEQ ID NO: 19788
  Payload ID: 3954
  Gene Symbol: CPNE2
  Gene Name: copine II
  Uniprot ID: Q96FN4
  ENSP ID: ENSP00000456042

SEQ ID NO: 19793 - protein, 281 aa, Homo sapiens
  Payload ID: 3954
  Gene Symbol: CPNE2
  Gene Name: copine II
  ENSP ID: ENSP00000457579
  MOD_RES (1)..(1): Any amino acid
XFGKSDPFLEFYKPGDDGKWMLVHRTEVIKYTLDPVWKPFTVPLVSLCDGDMEKPIQVMCYDYDNDGGHDFIGEFQTSVSQMCEARDSVPLEFECINPKKQRKKKNYKNSGIIILRSCKINRDYSFLDYILGGCQLMFTPWARLLQSTCCGELPADRGDGHCSTRQPQVGIDFTASNGNPLDPSSLHYINPMGTNEYLSAIWAVGQIIQDYDSDKMFPALGFGAQLPPDWKVSHEFAINFNPTNPFCSGVDGIAQAYSACLPHIRFYGPTNFSPIVNHVAR

SEQ ID NO: 19794 - protein, 537 aa, Homo sapiens
  Payload ID: 3955
  Gene Symbol: CPNE3
  Gene Name: copine III
  Uniprot ID: O75131
  ENSP ID: ENSP00000198765
MAAQCVTKVALNVSCANLLDKDIGSKSDPLCVLFLNTSGQQWYEVERTERIKNCLNPQFSKTFIIDYYFEVVQKLKFGVYDIDNKTIELSDDDFLGECECTLGQIVSSKKLTRPLVMKTGRPAGKGSITISAEEIKDNRVVLFEMEARKLDNKDLFGKSDPYLEFHKQTSDGNWLMVHRTEVVKNNLNPVWRPFKISLNSLCYGDMDKTIKVECYDYDNDGSHDLIGTFQTTMTKLKEASRSSPVEFECINEKKRQKKKSYKNSGVISVKQCEITVECTFLDYIMGGCQLNFTVGVDFTGSNGDPRSPDSLHYISPNGVNEYLTALWSVGLVIQDYDADKMFPAFGFGAQIPPQWQVSHEFPMNFNPSNPYCNGIQGIVEAYRSCLPQIKLYGPTNFSPIINHVARFAAAATQQQTASQYFVLLIITDGVITDLDETRQAIVNASRLPMSIIIVGVGGADFSAMEFLDGDGGSLRSPLGEVAIRDIVQFVPFRQFQNAPKEALAQCVLAEIPQQVVGYFNTYKLLPPKNPATKQQKQ

SEQ ID NO: 19795 - protein, 79 aa, Homo sapiens
  Payload ID: 3955
  Gene Symbol: CPNE3
  Gene Name: copine III
  ENSP ID: ENSP00000427966
MAAQCVTKVALNVSCANLLDKDIGSKSDPLCVLFLNTSGQQWYEVERTERIKNCLNPQFSKTFIIDYYFEVVQKLKFGV

SEQ ID NO: 19796 - protein, 262 aa, Homo sapiens
  Payload ID: 3955
  Gene Symbol: CPNE3
  Gene Name: copine III
  ENSP ID: ENSP00000428561
  MOD_RES (1)..(1): Any amino acid
XKTIELSDDDFLGECECTLGQIVSSKKLTRPLVMKTGRPAGKGSITISAEEIKDNRVVLFEMEARKLDNKVVKNNLNPVWRPFKISLNSLCYGDMDKTIKVECYDYDNDGSHDLIGTFQTTMTKLKEASRSSPVEFECINEKKRQKKKSYKNSGVISVKQCEITVECTFLDYIMGGCQLNFTVGVDFTGSNGDPRSPDSLHYISPNGVNEYLTALWSVGLVIQDYDADKMFPAFGFGAQIPPQWQVSHEFPMNFNPSNPYCN

SEQ ID NO: 19797 - protein, 153 aa, Homo sapiens
  Payload ID: 3955
  Gene Symbol: CPNE3
  Gene Name: copine III
  ENSP ID: ENSP00000429561
MAAQCVTKVALNVSCANLLDKDIGSKSDPLCVLFLNTSGQQWYEVERTERIKNCLNPQFSKTFIIDYYFEVVQKLKFGVYDIDNKTIELSDDDFLGECECTLGQIVSSKKLTRPLVMKTGRPAGKGSITISAEEIKDNRVVLFEMEARKLDNK

SEQ ID NO: 19798 - protein, 537 aa, Homo sapiens; identical to SEQ ID NO: 19794
  Payload ID: 3955
  Gene Symbol: CPNE3
  Gene Name: copine III
  Uniprot ID: O75131
  ENSP ID: ENSP00000477590

SEQ ID NO: 19799 - protein, 135 aa, Homo sapiens
  Payload ID: 3955
  Gene Symbol: CPNE3
  Gene Name: copine III
  ENSP ID: ENSP00000478894
MAAQCVTKVALNVSCANLLDKDIGSKSDPLCVLFLNTSGQQWYEVERTERIKNCLNPQFSKTFIIDYYFEVVQKLKFGVYDIDNKTIELSDDDFLGECECTLGQIVSSKKLTRPLVMKTGRPAGKGSITISAEEI

SEQ ID NO: 19800 - protein, 8 aa, Homo sapiens
  Payload ID: 3955
  Gene Symbol: CPNE3
  Gene Name: copine III
  ENSP ID: ENSP00000479670
MAAQCVTK

SEQ ID NO: 19801 - protein, 139 aa, Homo sapiens
  Payload ID: 3955
  Gene Symbol: CPNE3
  Gene Name: copine III
  ENSP ID: ENSP00000481234
MAAQCVTKVALNVSCANLLDKDIGSKSDPLCVLFLNTSGQQWYEVERTERIKNCLNPQFSKTFIIDYYFEVVQKLKFGVYDIDNKTIELSDDDFLGECECTLGQIVSSKKLTRPLVMKTGRPAGKGSITISAEEIKDNR

SEQ ID NO: 19802 - protein, 234 aa, Homo sapiens
  Payload ID: 3955
  Gene Symbol: CPNE3
  Gene Name: copine III
  ENSP ID: ENSP00000482002
MAAQCVTKVALNVSCANLLDKDIGSKSDPLCVLFLNTSGQQWYEVERTERIKNCLNPQFSKTFIIDYYFEVVQKLKFGVYDIDNKTIELSDDDFLGECECTLGQIVSSKKLTRPLVMKTGRPAGKGSITISAEEIKDNRVVLFEMEARKLDNKDLFGKSDPYLEFHKQTSDGNWLMVHRTEVVKNNLNPVWRPFKISLNSLCYGDMDKTIKVECYDYDNDGSHDLIGTFQTTMT

SEQ ID NO: 19803 - protein, 557 aa, Homo sapiens
  Payload ID: 3956
  Gene Symbol: CPNE4
  Gene Name: copine IV
  Uniprot ID: Q96A23
  ENSP ID: ENSP00000411904
MKKMSNIYESAANTLGIFNSPCLTKVELRVACKGISDRDALSKPDPCVILKMQSHGQWFEVDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDKDFFSKSDPFLEIFRMNDDATQQLVHRTEVVMNNLSPAWKSFKVSVNSLCSGDPDRRLKCIVWDWDSNGKHDFIGEFTSTFKEMRGAMEGKQVQWECINPKYKAKKKNYKNSGTVILNLCKIHKMHSFLDYIMGGCQIQFTVAIDFTASNGDPRNSCSLHYIHPYQPNEYLKALVAVGEICQDYDSDKMFPAFGFGARIPPEYTVSHDFAINFNEDNPECAGIQGVVEAYQSCLPKLQLYGPTNIAPIIQKVAKSASEETNTKEASQYFILLILTDGVITDMADTREAIVHASHLPMSVIIVGVGNADFSDMQMLDGDDGILRSPKGEPVLRDIVQFVPFRNFKHASPAALAKSVLAEVPNQVVDYYNGKGIKPKCSSEMYESSRTLAP

SEQ ID NO: 19804 - protein, 73 aa, Homo sapiens
  Payload ID: 3956
  Gene Symbol: CPNE4
  Gene Name: copine IV
  ENSP ID: ENSP00000421394
MKKMSNIYESAANTLGIFNSPCLTKVELRVACKGISDRDALSKPDPCVILKMQSHGQWFEVDRTEVIRTCINP

SEQ ID NO: 19805 - protein, 575 aa, Homo sapiens
  Payload ID: 3956
  Gene Symbol: CPNE4
  Gene Name: copine IV
  Uniprot ID: Q96A23
  ENSP ID: ENSP00000421646
MAVEPSSSESIKRRAGRRMKKMSNIYESAANTLGIFNSPCLTKVELRVACKGISDRDALSKPDPCVILKMQSHGQWFEVDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDKDFFSKSDPFLEIFRMNDDATQQLVHRTEVVMNNLSPAWKSFKVSVNSLCSGDPDRRLKCIVWDWDSNGKHDFIGEFTSTFKEMRGAMEGKQVQWECINPKYKAKKKNYKNSGTVILNLCKIHKMHSFLDYIMGGCQIQFTVAIDFTASNGDPRNSCSLHYIHPYQPNEYLKALVAVGEICQDYDSDKMFPAFGFGARIPPEYTVSHDFAINFNEDNPECAGIQGVVEAYQSCLPKLQLYGPTNIAPIIQKVAKSASEETNTKEASQYFILLILTDGVITDMADTREAIVHASHLPMSVIIVGVGNADFSDMQMLDGDDGILRSPKGEPVLRDIVQFVPFRNFKHASPAALAKSVLAEVPNQVVDYYNGKGIKPKCSSEMYESSRTLAP

SEQ ID NO: 19806 - protein, 557 aa, Homo sapiens; identical to SEQ ID NO: 19803
  Payload ID: 3956
  Gene Symbol: CPNE4
  Gene Name: copine IV
  Uniprot ID: Q96A23
  ENSP ID: ENSP00000421705

SEQ ID NO: 19807 - protein, 557 aa, Homo sapiens; identical to SEQ ID NO: 19803
  Payload ID: 3956
  Gene Symbol: CPNE4
  Gene Name: copine IV
  Uniprot ID: Q96A23
  ENSP ID: ENSP00000423811

SEQ ID NO: 19808 - protein, 575 aa, Homo sapiens; identical to SEQ ID NO: 19805
  Payload ID: 3956
  Gene Symbol: CPNE4
  Gene Name: copine IV
  Uniprot ID: Q96A23
  ENSP ID: ENSP00000424853

SEQ ID NO: 19809 - protein, 169 aa, Homo sapiens
  Payload ID: 3956
  Gene Symbol: CPNE4
  Gene Name: copine IV
  ENSP ID: ENSP00000425506
MKKMSNIYESAANTLGIFNSPCLTKVELRVACKGISDRDALSKPDPCVILKMQSHGQWFEVDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDK

SEQ ID NO: 19810 - protein, 82 aa, Homo sapiens
  Payload ID: 3956
  Gene Symbol: CPNE4
  Gene Name: copine IV
  ENSP ID: ENSP00000427561
MKKMSNIYESAANTLGIFNSPCLTKVELRVACKGISDRDALSKPDPCVILKMQSHGQWFEVDRTEVIRTCINPVYSKLFTVD

SEQ ID NO: 19811 - protein, 575 aa, Homo sapiens; identical to SEQ ID NO: 19805
  Payload ID: 3956
  Gene Symbol: CPNE4
  Gene Name: copine IV
  Uniprot ID: Q96A23
  ENSP ID: ENSP00000478878

SEQ ID NO: 19812 - protein, 593 aa, Homo sapiens
  Payload ID: 3957
  Gene Symbol: CPNE5
  Gene Name: copine V
  Uniprot ID: Q9HCH3
  ENSP ID: ENSP00000244751
MEQPEDMASLSEFDSLAGSIPATKVEITVSCRNLLDKDMFSKSDPLCVMYTQGMENKQWREFGRTEVIDNTLNPDFVRKFIVDYFFEEKQNLRFDLYDVDSKSPDLSKHDFLGQAFCTLGEIVGSPGSRLEKPLTIGAFSLNSRTGKPMPAVSNGGVPGKKCGTIILSAEELSNCRDVATMQFCANKLDKKDFFGKSDPFLVFYRSNEDGTFTICHKTEVMKNTLNPVWQTFSIPVRALCNGDYDRTIKVEVYDWDRDGSHDFIGEFTTSYRELARGQSQFNIYEVVNPKKKMKKKKYVNSGTVTLLSFAVESECTFLDYIKGGTQINFTVAIDFTASNGNPSQSTSLHYMSPYQLNAYALALTAVGEIIQHYDSDKMFPALGFGAKLPPDGRVSHEFPLNGNQENPSCCGIDGILEAYHRSLRTVQLYGPTNFAPVVTHVARNAAAVQDGSQYSVLLIITDGVISDMAQTKEAIVNAAKLPMSIIIVGVGQAEFDAMVELDGDDVRISSRGKLAERDIVQFVPFRDYVDRTGNHVLSMARLARDVLAEIPDQLVSYMKAQGIRPRPPPAAPTHSPSQSPARTPPASPLHTHI

SEQ ID NO: 19813 - protein, 301 aa, Homo sapiens
  Payload ID: 3957
  Gene Symbol: CPNE5
  Gene Name: copine V
  Uniprot ID: Q9HCH3
  ENSP ID: ENSP00000376885
MKKKKYVNSGTVTLLSFAVESECTFLDYIKGGTQINFTVAIDFTASNGNPSQSTSLHYMSPYQLNAYALALTAVGEIIQHYDSDKMFPALGFGAKLPPDGRVSHEFPLNGNQENPSCCGIDGILEAYHRSLRTVQLYGPTNFAPVVTHVARNAAAVQDGSQYSVLLIITDGVISDMAQTKEAIVNAAKLPMSIIIVGVGQAEFDAMVELDGDDVRISSRGKLAERDIVQFVPFRDYVDRTGNHVLSMARLARDVLAEIPDQLVSYMKAQGIRPRPPPAAPTHSPSQSPARTPPASPLHTHI

SEQ ID NO: 19814 - protein, 290 aa, Homo sapiens
  Payload ID: 3957
  Gene Symbol: CPNE5
  Gene Name: copine V
  ENSP ID: ENSP00000487872
AGSIPATKVEITVSCRNLLDKDMFSKSDPLCVMYTQGMENKQWREFGRTEVIDNTLNPDFVRKFIVDYFFEEKQNLRFDLYDVDSKSPDLSKHDFLGQAFCTLGEIVGSPGSRLEKPLTIGAFSLNSRTGKPMPAVSNGSGLWMESLRTTGLEASGGVPGKKCGTIILSAEELSNCRDVATMQFCANKLDKKDFFGKSDPFLVFYRSNEDGTFTICHKTEVMKNTLNPVWQTFSIPVRALCNGDYDRTIKVEVYDWDRDGSHDFIGEFTTSYRELARGQSQFNIYEVVNP

SEQ ID NO: 19815 - protein, 226 aa, Homo sapiens
  Payload ID: 3957
  Gene Symbol: CPNE5
  Gene Name: copine V
  ENSP ID: ENSP00000488125
MEQPEDMASLSEFDSLAGSIPATKVEITVSCRNLLDKDMFSKSDPLCVMYTQGMENKQWREFGRTEVIDNTLNPDFVRKFIVDYFFEEKQNLRFDLYDVDSKSPDLSKHDFLGQAFCTLGEIVGSPGSRLEKPLTIGAFSLNSRTGKPMPAVSNGGLWMESLRTTGLEASGGVPGKKCGTIILSAEELSNCRDVATMQFCANKLDKKDFFGKSDPFLVFYRSNEDG

SEQ ID NO: 19816 - protein, 557 aa, Homo sapiens
  Payload ID: 3958
  Gene Symbol: CPNE6
  Gene Name: copine VI (neuronal)
  Uniprot ID: O95741
  ENSP ID: ENSP00000380211
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITIVAEEVSGTNDYVQLTFRAYKLDNKDLFSKSDPFMEIYKTNEDQSDQLVWRTEVVKNNLNPSWEPFRLSLHSLCSCDVHRPLKFLVYDYDSSGKHDFIGEFTSTFQEMQEGTANPGQEMQWDCINPKYRDKKKNYKSSGTVVLAQCTVEKVHTFLDYIMGGCQISFTVAIDFTASNGDPRSSQSLHCLSPRQPNHYLQALRAVGGICQDYDSDKRFPAFGFGARIPPNFEVSHDFAINFDPENPECEEISGVIASYRRCLPQIQLYGPTNVAPIINRVAEPAQREQSTGQATKYSVLLVLTDGVVSDMAETRTAIVRASRLPMSIIIVGVGNADFSDMRLLDGDDGPLRCPRGVPAARDIVQFVPFRDFKDAAPSALAKCVLAEVPRQVVEYYASQGISPGAPRPCTLATTPSPSP

SEQ ID NO: 19817 - protein, 612 aa, Homo sapiens
  Payload ID: 3958
  Gene Symbol: CPNE6
  Gene Name: copine VI (neuronal)
  Uniprot ID: O95741
  ENSP ID: ENSP00000440077
MAFKEHGKITSCCIPGPINSSRAGAGAGASGWSSKGVRARAREPERGAPDREPSDMSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITIVAEEVSGTNDYVQLTFRAYKLDNKDLFSKSDPFMEIYKTNEDQSDQLVWRTEVVKNNLNPSWEPFRLSLHSLCSCDVHRPLKFLVYDYDSSGKHDFIGEFTSTFQEMQEGTANPGQEMQWDCINPKYRDKKKNYKSSGTVVLAQCTVEKVHTFLDYIMGGCQISFTVAIDFTASNGDPRSSQSLHCLSPRQPNHYLQALRAVGGICQDYDSDKRFPAFGFGARIPPNFEVSHDFAINFDPENPECEEISGVIASYRRCLPQIQLYGPTNVAPIINRVAEPAQREQSTGQATKYSVLLVLTDGVVSDMAETRTAIVRASRLPMSIIIVGVGNADFSDMRLLDGDDGPLRCPRGVPAARDIVQFVPFRDFKDAAPSALAKCVLAEVPRQVVEYYASQGISPGAPRPCTLATTPSPSP

SEQ ID NO: 19818 - protein, 110 aa, Homo sapiens
  Payload ID: 3958
  Gene Symbol: CPNE6
  Gene Name: copine VI (neuronal)
  ENSP ID: ENSP00000452653
MEIYKTNEDQSDQLVWRTEVVKNNLNPSWEPFRLSLHSLCSCDVHRPLKFLVYDYDSSGKHDFIGEFTSTFQEMQEGTANPGQEMQWDCINPKYRDKKKNYKSSGTVVLA

SEQ ID NO: 19819 - protein, 153 aa, Homo sapiens
  Payload ID: 3958
  Gene Symbol: CPNE6
  Gene Name: copine VI (neuronal)
  ENSP ID: ENSP00000452826
MSDPEMGWVPEPPTMTLGASRVELRVSCHGLLDRDTLTKPHPCVLLKLYSDEQWVEVRAAQVERTEVLRSCSSPVFSRVLALEYFFEEKQPLQFHVFDAEDGATSPRNDTFLGSTECTLGQIVSQTKVTKPLLLKNGKTAGKSTITIVAEEVS

SEQ ID NO: 19820 - protein, 159 aa, Homo sapiens
  Payload ID: 3958
  Gene Symbol: CPNE6
  Gene Name: copine VI (neuronal)
  ENSP ID: ENSP00000452884
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITVGKITCTHPWSRSWPRRY

SEQ ID NO: 19821 - protein, 158 aa, Homo sapiens
  Payload ID: 3958
  Gene Symbol: CPNE6
  Gene Name: copine VI (neuronal)
  ENSP ID: ENSP00000453261
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITDLFSKSDPFMEIYKTNE

SEQ ID NO: 19822 - protein, 26 aa, Homo sapiens
  Payload ID: 3958
  Gene Symbol: CPNE6
  Gene Name: copine VI (neuronal)
  ENSP ID: ENSP00000453326
MEIYKTNEDQSDQLVWRTEVVKNNLN

SEQ ID NO: 19823 - protein, 226 aa, Homo sapiens
  Payload ID: 3958
  Gene Symbol: CPNE6
  Gene Name: copine VI (neuronal)
  ENSP ID: ENSP00000453352
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITIVAEEVSGTNDYVQLTFRAYKLDNKDLFSKSDPFMEIYKTNEDQSDQLVWRTEVVKNNLNPSWEPFRLSLHSLCSCDVHRPLKFL

SEQ ID NO: 19824 - protein, 105 aa, Homo sapiens
  Payload ID: 3958
  Gene Symbol: CPNE6
  Gene Name: copine VI (neuronal)
  ENSP ID: ENSP00000453483
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDT

SEQ ID NO: 19825 - protein, 149 aa, Homo sapiens
  Payload ID: 3958
  Gene Symbol: CPNE6
  Gene Name: copine VI (neuronal)
  ENSP ID: ENSP00000454075
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITIVAEEVSG

SEQ ID NO: 19826 - protein, 131 aa, Homo sapiens
  Payload ID: 3958
  Gene Symbol: CPNE6
  Gene Name: copine VI (neuronal)
  ENSP ID: ENSP00000454093
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKN

SEQ ID NO: 19827 - protein, 52 aa, Homo sapiens
  Payload ID: 3958
  Gene Symbol: CPNE6
  Gene Name: copine VI (neuronal)
  ENSP ID: ENSP00000454166
MSDPEMGWVPEPPTMTLGASRVELRVSCHGLLDRDTLTKPHPCVLLKLYSDE

SEQ ID NO: 19828 - protein, 65 aa, Homo sapiens
  Payload ID: 3958
  Gene Symbol: CPNE6
  Gene Name: copine VI (neuronal)
  ENSP ID: ENSP00000454172
MSDPEMGWVPEPPTMTLGASRVELRVSCHGLLDRDTLTKPHPCVLLKLYSDEQWVEPCLLPGAGP

SEQ ID NO: 19829 - protein, 141 aa, Homo sapiens
  Payload ID: 3958
  Gene Symbol: CPNE6
  Gene Name: copine VI (neuronal)
  ENSP ID: ENSP00000454192
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTIT

SEQ ID NO: 19830 - protein, 633 aa, Homo sapiens
  Payload ID: 3959
  Gene Symbol: CPNE7
  Gene Name: copine VII
  Uniprot ID: Q9UBL6
  ENSP ID: ENSP00000268720
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQPAQKWLLQVVMRVSVDVLGPAGHCAKHFLCCTESSHLARTGPSFLLRYDDLCLPWATAGAVRWWTCRGGHTQGWQIVAQKKVTRPLLLKFGRNAGKSTITVIAEDISGNNGYVELSFRARKLDDKDLFSKSDPFLELYRVNDDQGLQLVYRTEVVKNNLNPVWEAFKVSLSSLCSCEETRPLKCLVWDYDSRGKHDFIGEFSTTFEEMQKAFEEGQAQWDCVNPKYKQKRRSYKNSGVVVLADLKFHRVYSFLDYIMGGCQIHFTVAIDFTASNGDPRNSCSLHYINPYQPNEYLKALVSVGEICQDYDSDKRFSALGFGARIPPKYEVSHDFAINFNPEDDECEGIQGVVEAYQNCLPRVQLYGPTNVAPIISKVARVAAAEESTGKASQYYILLILTDGVVTDMADTREAIVRASRLPMSIIIVGVGNADFTDMQVLDGDDGVLRSPRGEPALRDIVQFVPFRELKNASPAALAKCVLAEVPKQVVEYYSHRGLPPRSLGVPAGEASPGCTP

SEQ ID NO: 19831 - protein, 558 aa, Homo sapiens
  Payload ID: 3959
  Gene Symbol: CPNE7
  Gene Name: copine VII
  Uniprot ID: Q9UBL6
  ENSP ID: ENSP00000317374
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQIVAQKKVTRPLLLKFGRNAGKSTITVIAEDISGNNGYVELSFRARKLDDKDLFSKSDPFLELYRVNDDQGLQLVYRTEVVKNNLNPVWEAFKVSLSSLCSCEETRPLKCLVWDYDSRGKHDFIGEFSTTFEEMQKAFEEGQAQWDCVNPKYKQKRRSYKNSGVVVLADLKFHRVYSFLDYIMGGCQIHFTVAIDFTASNGDPRNSCSLHYINPYQPNEYLKALVSVGEICQDYDSDKRFSALGFGARIPPKYEVSHDFAINFNPEDDECEGIQGVVEAYQNCLPRVQLYGPTNVAPIISKVARVAAAEESTGKASQYYILLILTDGVVTDMADTREAIVRASRLPMSIIIVGVGNADFTDMQVLDGDDGVLRSPRGEPALRDIVQFVPFRELKNASPAALAKCVLAEVPKQVVEYYSHRGLPPRSLGVPAGEASPGCTP

SEQ ID NO: 19832 - protein, 120 aa, Homo sapiens
  Payload ID: 3959
  Gene Symbol: CPNE7
  Gene Name: copine VII
  ENSP ID: ENSP00000431863
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQV

SEQ ID NO: 19833 - protein, 92 aa, Homo sapiens
  Payload ID: 3959
  Gene Symbol: CPNE7
  Gene Name: copine VII
  ENSP ID: ENSP00000434886
  MOD_RES (1)..(1): Any amino acid
XFVPFRELKNQRTAQGAPGIHHAASPVAANLCDPARHAQHTRIPCGAGQVRAGRGPEAGGGVLQPQRPAPEKPGCPCRRGQPRLHTVKMWRA

SEQ ID NO: 19834 - protein, 173 aa, Homo sapiens
  Payload ID: 3959
  Gene Symbol: CPNE7
  Gene Name: copine VII
  ENSP ID: ENSP00000435876
FHRVYSFLDYIMGGCQIHFTTKRERGETGVAIDFTASNGDPRNSCSLHYINPYQPNEYLKALVSVGEICQDYDSDKRFSALGFGARIPPKYEVSHDFAINFNPEDDECEGIQGVVEAYQNCLPRVQLYGPTNVAPIISKVARVAAAEESTGKASQYYILLILTDGVVTDMADT

SEQ ID NO: 19835 - protein, 98 aa, Homo sapiens
  Payload ID: 3959
  Gene Symbol: CPNE7
  Gene Name: copine VII
  ENSP ID: ENSP00000455086
DSDKRFSALGFGARIPPKYEVSHDFAINFNPEDDECEAILHPADPDGRRGDRHGRHTGGHCACLTPAHVHHHRGRGQRRLHRHAGPGRRRRRPALPTG

SEQ ID NO: 19836 - protein, 564 aa, Homo sapiens
  Payload ID: 3960
  Gene Symbol: CPNE8
  Gene Name: copine VIII
  Uniprot ID: Q86YQ8
  ENSP ID: ENSP00000329748
MDSRYNSTAGIGDLNQLSAAIPATRVEVSVSCRNLLDRDTFSKSDPICVLYVQGVGNKEWREFGRTEVIDNTLNPDFVRKFILDYFFEERENLRFDLYDVDSKSPNLSKHDFLGQVFCTLGEIVGSQGSRLEKPIVGIPGKKCGTIILTAEELNCCRDAVLMQFCANKLDKKDFFGKSDPFLVFYRSNEDGSFTICHKTEVVKNTLNPVWQAFKISVRALCNGDYDRTIKVEVYDWDRDGSHDFIGEFTTSYRELSRGQSQFNVYEVVNPKKKGKKKKYTNSGTVTLLSFLVETEVSFLDYIKGGTQINFTVAIDFTASNGNPAQPTSLHYMNPYQLNAYGMALKAVGEIVQDYDSDKMFPALGFGAKLPPDGRISHEFALNGNPQNPYCDGIEGVMEAYYRSLKSVQLYGPTNFAPVINHVARYASSVKDGSQYFVLLIVTDGVISDMAQTKESIVNASKLPMSIIIVGVGPAEFDAMVELDGDDVRVSSRGKYAERDIVQFVPFRDYIDRSGNHILSMARLAKDVLAEIPEQFLSYMRARGIKPSPAPPPYTPPTHVLQTQI

SEQ ID NO: 19837 - protein, 552 aa, Homo sapiens
  Payload ID: 3960
  Gene Symbol: CPNE8
  Gene Name: copine VIII
  ENSP ID: ENSP00000353633
MHFKCSSLYMLYLTEVETNWINLLDRDTFSKSDPICVLYVQGVGNKEWREFGRTEVIDNTLNPDFVRKFILDYFFEERENLRFDLYDVDSKSPNLSKHDFLGQVFCTLGEIVGSQGSRLEKPIVGIPGKKCGTIILTAEELNCCRDAVLMQFCANKLDKKDFFGKSDPFLVFYRSNEDGSFTICHKTEVVKNTLNPVWQAFKISVRALCNGDYDRTIKVEVYDWDRDGSHDFIGEFTTSYRELSRGQSQFNVYEVVNPKKKGKKKKYTNSGTVTLLSFLVETEVSFLDYIKGGTQINFTVAIDFTASNGNPAQPTSLHYMNPYQLNAYGMALKAVGEIVQDYDSDKMFPALGFGAKLPPDGRISHEFALNGNPQNPYCDGIEGVMEAYYRSLKSVQLYGPTNFAPVINHVARYASSVKDGSQYFVLLIVTDGVISDMAQTKESIVNASKLPMSIIIVGVGPAEFDAMVELDGDDVRVSSRGKYAERDIVQFVPFRDYIDRSGNHILSMARLAKDVLAEIPEQFLSYMRARGIKPSPAPPPYTPPTHVLQTQI

SEQ ID NO: 19838 - protein, 233 aa, Homo sapiens
  Payload ID: 3960
  Gene Symbol: CPNE8
  Gene Name: copine VIII
  Uniprot ID: Q86YQ8
  ENSP ID: ENSP00000439237
MNPYQLNAYGMALKAVGEIVQDYDSDKMFPALGFGAKLPPDGRISHEFALNGNPQNPYCDGIEGVMEAYYRSLKSVQLYGPTNFAPVINHVARYASSVKDGSQYFVLLIVTDGVISDMAQTKESIVNASKLPMSIIIVGVGPAEFDAMVELDGDDVRVSSRGKYAERDIVQFVPFRDYIDRSGNHILSMARLAKDVLAEIPEQFLSYMRARGIKPSPAPPPYTPPTHVLQTQI

SEQ ID NO: 19839 - protein, 12 aa, Homo sapiens
  Payload ID: 3960
  Gene Symbol: CPNE8
  Gene Name: copine VIII
  ENSP ID: ENSP00000447761
MQFCANKLDKKD

SEQ ID NO: 19840 - protein, 255 aa, Homo sapiens
  Payload ID: 3961
  Gene Symbol: CCS
  Gene Name: copper chaperone for superoxide dismutase
  ENSP ID: ENSP00000307870
MTCQSCVDAVRKSLQGVAGVQDVEVHLEDQMVLVHTTLPSQEVQALLEGTGRQAVLKGMGSGQLQNLGAAVAILGGPGTVQGVVRFLQLTPERCLIEGTIDGLEPGLHGLHVHQYGDLTNNCNSCGNHFNPDGASHGGPQDSDRHRGDLGNVRADADGRAIFRMEDEQLKVWDVIGRSLIIDEGEDDLGRGGHPLSKITGNSGERLACGIIARSAGLFQNPKQICSCDGLTIWEERGRPIAGKGRKESAQPPAHL

SEQ ID NO: 19841 - protein, 249 aa, Homo sapiens
  Payload ID: 3961
  Gene Symbol: CCS
  Gene Name: copper chaperone for superoxide dismutase
  ENSP ID: ENSP00000433609
MASDSGNQGTLCTLEFAVQMTCQSCVDAVRKSLQGVAGVQDVEVHLEDQMVLVHTTLPSQEVQALLEGTGRQAVLKGMGSGQLQNLGAAVAILGGPGTVQGVVRFLQLTPERCLIEGTIDGLEPGLHGLHVHQYGDLTNNCNSCGNHFNPDGASHGGPQDSDRTGPRGPCLPSPWGAQILRDWYPQEEMGTLGKQEEASESGNQKIAAWHHVAHIPYTHTGSHSSTAETWAMSVLMLTAAPSSEWRMSS

SEQ ID NO: 19842 - protein, 274 aa, Homo sapiens
  Payload ID: 3961
  Gene Symbol: CCS
  Gene Name: copper chaperone for superoxide dismutase
  Uniprot ID: O14618
  ENSP ID: ENSP00000436318
MASDSGNQGTLCTLEFAVQMTCQSCVDAVRKSLQGVAGVQDVEVHLEDQMVLVHTTLPSQEVQALLEGTGRQAVLKGMGSGQLQNLGAAVAILGGPGTVQGVVRFLQLTPERCLIEGTIDGLEPGLHGLHVHQYGDLTNNCNSCGNHFNPDGASHGGPQDSDRHRGDLGNVRADADGRAIFRMEDEQLKVWDVIGRSLIIDEGEDDLGRGGHPLSKITGNSGERLACGIIARSAGLFQNPKQICSCDGLTIWEERGRPIAGKGRKESAQPPAHL

SEQ ID NO: 19843 - protein, 68 aa, Homo sapiens
  Payload ID: 3961
  Gene Symbol: CCS
  Gene Name: copper chaperone for superoxide dismutase
  ENSP ID: ENSP00000436379
MEDEQLKVWDVIGRSLIIDEGEDDLGRGGHPLSKITGNSGERLACGIIARSAGLFQNPKQICSCDGLT

SEQ ID NO: 19844 - protein, 190 aa, Homo sapiens
  Payload ID: 3962
  Gene Symbol: COMMD1
  Gene Name: copper metabolism (Murr1) domain containing 1
  Uniprot ID: Q8N668
  ENSP ID: ENSP00000308236
MAAGELEGGKPLSGLLNALAQDTFHGYPGITEELLRSQLYPEVPPEEFRPFLAKMRGILKSIASADMDFNQLEAFLTAQTKKQGGITSDQAAVISKFWKSHKTKIRESLMNQSRWNSGLRGLSWRVDGKSQSRHSAQIHTPVAIIELELGKYGQESEFLCLEFDEVKVNQILKTLSEVEESISTLISQPN

SEQ ID NO: 19845 - protein, 50 aa, Homo sapiens
  Payload ID: 3962
  Gene Symbol: COMMD1
  Gene Name: copper metabolism (Murr1) domain containing 1
  ENSP ID: ENSP00000398727
  MOD_RES (1)..(1): Any amino acid
XPGITEELLRSQLYPEVPPEEFRPFLAKMRGILKRQNLPISSRVVSNSWA

SEQ ID NO: 19846 - protein, 38 aa, Homo sapiens
  Payload ID: 3962
  Gene Symbol: COMMD1
  Gene Name: copper metabolism (Murr1) domain containing 1
  ENSP ID: ENSP00000401236
  MOD_RES (1)..(1): Any amino acid
XQESEFLCLEFDEVKVNQILKTLSEVEESISTLISQPN

SEQ ID NO: 19847 - protein, 32 aa, Homo sapiens
  Payload ID: 3962
  Gene Symbol: COMMD1
  Gene Name: copper metabolism (Murr1) domain containing 1
  ENSP ID: ENSP00000410050
  MOD_RES (1)..(1): Any amino acid
XCLEFDEVKVNQILKTLSEVEESISTLISQPN

SEQ ID NO: 19848 - protein, 38 aa, Homo sapiens; identical to SEQ ID NO: 19846
  Payload ID: 3962
  Gene Symbol: COMMD1
  Gene Name: copper metabolism (Murr1) domain containing 1
  ENSP ID: ENSP00000413207
  MOD_RES (1)..(1): Any amino acid

SEQ ID NO: 19849 - protein, 98 aa, Homo sapiens
  Payload ID: 3962
  Gene Symbol: COMMD1
  Gene Name: copper metabolism (Murr1) domain containing 1
  ENSP ID: ENSP00000416997
MAAGELEGGKPLSGLLNALAQDTFHGYPGITEELLRSQLYPEVPPEEFRPFLAKMRGILKTGSCCVAQDRVQWVFIGTIMAHRGLELLGSSDSPASAS

SEQ ID NO: 19850 - protein, 454 aa, Homo sapiens
  Payload ID: 3963
  Gene Symbol: CPOX
  Gene Name: coproporphyrinogen oxidase
  Uniprot ID: P36551
  ENSP ID: ENSP00000264193
MALQLGRLSSGPCWLVARGGCGGPRAWSQCGGGGLRAWSQRSAAGRVCRPPGPAGTEQSRGLGHGSTSRGGPWVGTGLAAALAGLVGLATAAFGHVQRAEMLPKTSGTRATSLGRPEEEEDELAHRCSSFMAPPVTDLGELRRRPGDMKTKMELLILETQAQVCQALAQVDGGANFSVDRWERKEGGGGISCVLQDGCVFEKAGVSISVVHGNLSEEAAKQMRSRGKVLKTKDGKLPFCAMGVSSVIHPKNPHAPTIHFNYRYFEVEEADGNKQWWFGGGCDLTPTYLNQEDAVHFHRTLKEACDQHGPDLYPKFKKWCDDYFFIAHRGERRGIGGIFFDDLDSPSKEEVFRFVQSCARAVVPSYIPLVKKHCDDSFTPQEKLWQQLRRGRYVEFNLLYDRGTKFGLFTPGSRIESILMSLPLTARWEYMHSPSENSKEAEILEVLRHPRDWVR

SEQ ID NO: 19851 - protein, 175 aa, Homo sapiens
  Payload ID: 3963
  Gene Symbol: CPOX
  Gene Name: coproporphyrinogen oxidase
  ENSP ID: ENSP00000424924
MALQLGRLSSGPCWLVARGGCGGPRAWSQCGGGGLRAWSQRSAAGRVCRPPGPAGTEQSRGLGHGSTSRGGPWVGTGLAAALAGLVGLATAAFGHVQRAEMLPKTSGTRATSLGRPEEEEDELAHRCSSFMAPPVTDLGELRRRPGDMKTKMELLILETQAQVCQALAQRKLQNK

SEQ ID NO: 19852 - protein, 70 aa, Homo sapiens
  Payload ID: 3963
  Gene Symbol: CPOX
  Gene Name: coproporphyrinogen oxidase
  ENSP ID: ENSP00000425880
  MOD_RES (1)..(1): Any amino acid
XCDDSFTPQEKLWQQLRRGRYVEFNLLYDRGTKFGLFTPGSRIESILMSLPLTARQFSAILFLNSVEDFF

SEQ ID NO: 19853 - protein, 1261 aa, Homo sapiens
  Payload ID: 3964
  Gene Symbol: COBL
  Gene Name: cordon-bleu WH2 repeat protein
  Uniprot ID: O75128
  ENSP ID: ENSP00000265136
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKVASSASEELQSFRDAALSAQGSESPLLEDLGLLSPPAIPPPPPPPSQALSAPRTASRFSTGTLSNTADARQALMDAIRSGTGAARLRKVPLLV

SEQ ID NO: 19854 - protein, 469 aa, Homo sapiens
  Payload ID: 3964
  Gene Symbol: COBL
  Gene Name: cordon-bleu WH2 repeat protein
  Uniprot ID: O75128
  ENSP ID: ENSP00000378910
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVYGAAEAVIRLLSLLLNTTAPGTAKPRTLWMSEGRSSLHNPEIKCSCFSSSSPFPQSLLSLLLGLSSICECMCTLRHTHAHTHNPSCVLPTSEILAFGRQSLIS

SEQ ID NO: 19855 - protein, 1271 aa, Homo sapiens
  Payload ID: 3964
  Gene Symbol: COBL
  Gene Name: cordon-bleu WH2 repeat protein
  Uniprot ID: O75128
  ENSP ID: ENSP00000378912
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMGGGRQVPQKPPRGTARGPPQLVLPPPPPYPPPDTDVVEPLSFPGEGAGSEASDPIPKLSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKALSAPRTASRFSTGTLSNTADARQALMDAIRSGTGAARLRKVPLLV

SEQ ID NO: 19856 - protein, 163 aa, Homo sapiens
  Payload ID: 3964
  Gene Symbol: COBL
  Gene Name: cordon-bleu WH2 repeat protein
  ENSP ID: ENSP00000391864
MKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQN

SEQ ID NO: 19857 - protein, 379 aa, Homo sapiens
  Payload ID: 3964
  Gene Symbol: COBL
  Gene Name: cordon-bleu WH2 repeat protein
  Uniprot ID: O75128
  ENSP ID: ENSP00000399500
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVYCCASFPTQAKRF

SEQ ID NO: 19858 - protein, 1106 aa, Homo sapiens
  Payload ID: 3964
  Gene Symbol: COBL
  Gene Name: cordon-bleu WH2 repeat protein
  ENSP ID: ENSP00000401204
LKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKAEQLVLSGADSDEDTSRAAPGRGLNGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKALSAPRTASRFSTGTLSNTADARQALMDAIRSGTGAARLRKVPLLV

SEQ ID NO: 19859 - protein, 614 aa, Homo sapiens
  Payload ID: 3964
  Gene Symbol: COBL
  Gene Name: cordon-bleu WH2 repeat protein
  ENSP ID: ENSP00000405059
  MOD_RES (1)..(1): Any amino acid
XHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMGGGRQVPQKPPRGTARGPPQLVLPPPPPYPPPDTDVVEPLSFPGEGAGSEASDPIPKLSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNL

SEQ ID NO: 19860 - protein, 1146 aa, Homo sapiens
  Payload ID: 3964
  Gene Symbol: COBL
  Gene Name: cordon-bleu WH2 repeat protein
  ENSP ID: ENSP00000413498
LRDNIAGEELELSKSLNELGIKELYAWDNRRETFRKSSLGNDETDKEKKKFLGFFKVNKRSNSKAEQLVLSGADSDEDTSRAAPGRGLNGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMGGGRQVPQKPPRGTARGPPQLVLPPPPPYPPPDTDVVEPLSFPGEGAGSEASDPIPKLSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKVASSASEELQSFRDAALSAQGSESPLLEDLGLLSPPAIPPPPPPPSQALSAPRTASRFSTGTLSNTADARQALMDAIRSGTGAARLRKVPLLV

SEQ ID NO: 19861 - protein, 394 aa, Homo sapiens
  Payload ID: 3964
  Gene Symbol: COBL
  Gene Name: cordon-bleu WH2 repeat protein
  ENSP ID: ENSP00000488001
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRVRLSKTQSEPSLSCQETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVYCCASFPTQAKRF

SEQ ID NO: 19862 - protein, 1166 aa, Homo sapiens
  Payload ID: 3965
  Gene Symbol: COBLL1
  Gene Name: cordon-bleu WH2 repeat protein-like 1
  Uniprot ID: Q53SF7
  ENSP ID: ENSP00000341360
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPETFHPGLSSQEQCTAPKLMEETSVFECPGTPEAAITSLTSGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 19863 - protein, 1128 aa, Homo sapiens
  Payload ID: 3965
  Gene Symbol: COBLL1
  Gene Name: cordon-bleu WH2 repeat protein-like 1
  Uniprot ID: Q53SF7
  ENSP ID: ENSP00000364607
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPAGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 19864 - protein, 1204 aa, Homo sapiens
  Payload ID: 3965
  Gene Symbol: COBLL1
  Gene Name: cordon-bleu WH2 repeat protein-like 1
  Uniprot ID: Q53SF7
  ENSP ID: ENSP00000376478
MCGRAAEAAASSRTPGREMGQAVTRRLGAGARAAPRRAMDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPETFHPGLSSQEQCTAPKLMEETSVFECPGTPEAAITSLTSGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 19865 - protein, 1168 aa, Homo sapiens
  Payload ID: 3965
  Gene Symbol: COBLL1
  Gene Name: cordon-bleu WH2 repeat protein-like 1
  Uniprot ID: Q53SF7
  ENSP ID: ENSP00000387326
  MOD_RES (1)..(1): Any amino acid
XLMCGRAAEAAASSRTPGREMGQAVTRRLGAGARAAPRRAMDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPAGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 19866 - protein, 138 aa, Homo sapiens
  Payload ID: 3965
  Gene Symbol: COBLL1
  Gene Name: cordon-bleu WH2 repeat protein-like 1
  ENSP ID: ENSP00000387967
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKP

SEQ ID NO: 19867 - protein, 148 aa, Homo sapiens
  Payload ID: 3965
  Gene Symbol: COBLL1
  Gene Name: cordon-bleu WH2 repeat protein-like 1
  ENSP ID: ENSP00000388110
MPPSWSPLMCGRAAEAAASSRTPGREMGQAVTRRLGAGARAAPRRAMDGRTPRPQDAPARREIAGSWRKPKAKAPLPPAETKYTDVSSAADSVESTAFIMEQKENMIDKDVELSVVLPGDIIKSTTVHGSKPMMDLLIFLCAQYHLNP

SEQ ID NO: 19868 - protein, 226 aa, Homo sapiens
  Payload ID: 3965
  Gene Symbol: COBLL1
  Gene Name: cordon-bleu WH2 repeat protein-like 1
  ENSP ID: ENSP00000397520
MPPSWSPLMCGRAAEAAASSRTPGREMGQAVTRRLGAGARAAPRRAMDGRTPRPQDAPASKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRATSVTVFSKSSLQESCQISQNLD

SEQ ID NO: 19869 - protein, 163 aa, Homo sapiens
  Payload ID: 3965
  Gene Symbol: COBLL1
  Gene Name: cordon-bleu WH2 repeat protein-like 1
  ENSP ID: ENSP00000397835
MLETLVGKLKCCIGEESDSQKRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKT

SEQ ID NO: 19870 - protein, 258 aa, Homo sapiens
  Payload ID: 3965
  Gene Symbol: COBLL1
  Gene Name: cordon-bleu WH2 repeat protein-like 1
  ENSP ID: ENSP00000400146
  MOD_RES (1)..(1): Any amino acid
XSARGTILFYGDFLEQLRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRESCQISQNLDIMKEKENKGFFSFFQRSKKKRDQTA

SEQ ID NO: 19871 - protein, 157 aa, Homo sapiens
  Payload ID: 3965
  Gene Symbol: COBLL1
  Gene Name: cordon-bleu WH2 repeat protein-like 1
  ENSP ID: ENSP00000406062
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQ

SEQ ID NO: 19872 - protein, 170 aa, Homo sapiens
  Payload ID: 3965
  Gene Symbol: COBLL1
  Gene Name: cordon-bleu WH2 repeat protein-like 1
  ENSP ID: ENSP00000409237
MKKDLKEGPSLCGLCLEELKGDFLVERLRENIPAVRRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVR

SEQ ID NO: 19873 - protein, 424 aa, Homo sapiens
  Payload ID: 3965
  Gene Symbol: COBLL1
  Gene Name: cordon-bleu WH2 repeat protein-like 1
  ENSP ID: ENSP00000416311
MDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRATSVTVFSKSSLQESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPGNI

SEQ ID NO: 19874 - protein, 1233 aa, Homo sapiens
  Payload ID: 3965
  Gene Symbol: COBLL1
  Gene Name: cordon-bleu WH2 repeat protein-like 1
  ENSP ID: ENSP00000487041
MPPSWSPLMCGRAAEAAASSRTPGREMGQAVTRRLGAGARAAPRRAMDGRTPRPQDAPARREIAGSWRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRVVINFKKTQKTIVRVSPHASLQELAPIICSKCEFDPLHTLLLKDYQSQEPLDLTKSLNDLGLRELYAMDVNRATSVTVFSKSSLQESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPETFHPGLSSQEQCTAPKLMEETSVFECPGTPEAAITSLTSGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 19875 - protein, 363 aa, Homo sapiens
  Payload ID: 3966
  Gene Symbol: C1GALT1
  Gene Name: core 1 synthase, glycoprotein-N-acetylgalactosamine 3-beta-galactosyltransferase 1
  Uniprot ID: Q9NS00
  ENSP ID: ENSP00000223122
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPAVGLKTKEGRDQLYWKTIKAFQYVHEHYLEDADWFLKADDDTYVILDNLRWLLSKYDPEEPIYFGRRFKPYVKQGYMSGGAGYVLSKEALKRFVDAFKTDKCTHSSSIEDLALGRCMEIMNVEAGDSRDTIGKETFHPFVPEHHLIKGYLPRTFWYWNYNYYPPVEGPGCCSDLAVSFHYVDSTTMYELEYLVYHLRPYGYLYRYQPTLPERILKEISQANKNEDTKVKLGNP

SEQ ID NO: 19876 - protein, 309 aa, Homo sapiens
  Payload ID: 3966
  Gene Symbol: C1GALT1
  Gene Name: core 1 synthase, glycoprotein-N-acetylgalactosamine 3-beta-galactosyltransferase 1
  Uniprot ID: Q9NS00
  ENSP ID: ENSP00000384550
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPAVGLKTKEGRDQLYWKTIKAFQYVHEHYLEDADWFLKADDDTYVILDNLRWLLSKYDPEEPIYFGRRFKPYVKQGYMSGGAGYVLSKEALKRFVDAFKTDKCTHSSSIEDLALGRCMEIMNVEAGDSRDTIGKETFHPFVPEHHLIKGYLPRTFWYWNYNYYPPVEVSLEILLLCQYLD

SEQ ID NO: 19877 - protein, 363 aa, Homo sapiens; identical to SEQ ID NO: 19875
  Payload ID: 3966
  Gene Symbol: C1GALT1
  Gene Name: core 1 synthase, glycoprotein-N-acetylgalactosamine 3-beta-galactosyltransferase 1
  Uniprot ID: Q9NS00
  ENSP ID: ENSP00000389176

SEQ ID NO: 19878 - protein, 131 aa, Homo sapiens
  Payload ID: 3966
  Gene Symbol: C1GALT1
  Gene Name: core 1 synthase, glycoprotein-N-acetylgalactosamine 3-beta-galactosyltransferase 1
  ENSP ID: ENSP00000407666
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPA

SEQ ID NO: 19879 - protein, 100 aa, Homo sapiens
  Payload ID: 3966
  Gene Symbol: C1GALT1
  Gene Name: core 1 synthase, glycoprotein-N-acetylgalactosamine 3-beta-galactosyltransferase 1
  ENSP ID: ENSP00000415400
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNL

SEQ ID NO: 19880 - protein, 182 aa, Homo sapiens
  Payload ID: 3967
  Gene Symbol: CBFB
  Gene Name: core-binding factor, beta subunit
  Uniprot ID: Q13951
  ENSP ID: ENSP00000290858
MPRVVPDQRSKFENEEFFRKLSRECEIKYTGFRDRPHEERQARFQNACRDGRSEIAFVATGTNLSLQFFPASWQGEQRQTPSREYVDLEREAGKVYLKAPMILNGVCVIWKGWIDLQRLDGMGCLEFDEERAQQEDALAQQAFEEARRRTREFEDRDRSHREEMEVRVSQLLAVTGKKTTRP

SEQ ID NO: 19881 - protein, 187 aa, Homo sapiens
  Payload ID: 3967
  Gene Symbol: CBFB
  Gene Name: core-binding factor, beta subunit
  Uniprot ID: Q13951
  ENSP ID: ENSP00000415151
MPRVVPDQRSKFENEEFFRKLSRECEIKYTGFRDRPHEERQARFQNACRDGRSEIAFVATGTNLSLQFFPASWQGEQRQTPSREYVDLEREAGKVYLKAPMILNGVCVIWKGWIDLQRLDGMGCLEFDEERAQQEDALAQQAFEEARRRTREFEDRDRSHREEMEARRQQDPSPGSNLGGGDDLKLR

SEQ ID NO: 19882 - protein, 93 aa, Homo sapiens
  Payload ID: 3967
  Gene Symbol: CBFB
  Gene Name: core-binding factor, beta subunit
  ENSP ID: ENSP00000456637
MPRVVPDQRSKFENEEFFRKLSRECEIKYTGFRDRPHEERQARFQNACRDGRSEIVYLKAPMILNGVCVIWKGWIDLQRLDGMGCLEFDEERA

SEQ ID NO: 19883 - protein, 61 aa, Homo sapiens
  Payload ID: 3967
  Gene Symbol: CBFB
  Gene Name: core-binding factor, beta subunit
  ENSP ID: ENSP00000462148
MILNGVCVIWKGWIDLQRLDGMGCLEFDEERAQQEDALAQQAFEEARRRTREFEDRDRSHR

SEQ ID NO: 19884 - protein, 82 aa, Homo sapiens
  Payload ID: 3967
  Gene Symbol: CBFB
  Gene Name: core-binding factor, beta subunit
  ENSP ID: ENSP00000462273
MILNGVCVIWKGWIDLQRLDGMGCLEFDEERAQQEDALAQQAFEEARRRTREFEDRDRSHREEMEVRVSQLLAVTGKKTTRP

SEQ ID NO: 19885 - protein, 60 aa, Homo sapiens
  Payload ID: 3967
  Gene Symbol: CBFB
  Gene Name: core-binding factor, beta subunit
  ENSP ID: ENSP00000462932
  MOD_RES (1)..(1): Any amino acid
XRKLSRECEIKYTGFRDRPHEERQARFQNACRDGRSEIARRQQDPSPGSNLGGGDDLKLR

SEQ ID NO: 19886 - protein, 604 aa, Homo sapiens
  Payload ID: 3968
  Gene Symbol: CBFA2T2
  Gene Name: core-binding factor, runt domain, alpha subunit 2
  translocated to, 2
  Uniprot ID: O43439
  ENSP ID: ENSP00000262653
MAKESGISLKEIQVLARQWKVGPEKRVPAMPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHALNCIMEMVEKTRRSMAVLRRCQESDREELNYWKRRYNENTELRKTGTELVSRQHSPGSADSLSNDSQREFNSRPGTGYVPVEFWKKTEEAVNKVKIQAMSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 19887 - protein, 263 aa, Homo sapiens
  Payload ID: 3968
  Gene Symbol: CBFA2T2
  Gene Name: core-binding factor, runt domain, alpha subunit 2
  translocated to, 2
  Uniprot ID: O43439
  ENSP ID: ENSP00000341865
MPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPESCIIHLKSMGVASRHEYFSGTLQMPAHPVRNSTLENLWVDCSRSLRSTVLPFP

SEQ ID NO: 19888 - protein, 595 aa, Homo sapiens
  Payload ID: 3968
  Gene Symbol: CBFA2T2
  Gene Name: core-binding factor, runt domain, alpha subunit 2
  translocated to, 2
  Uniprot ID: O43439
  ENSP ID: ENSP00000345810
MVGVPGAAAFQLGPEKRVPAMPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHALNCIMEMVEKTRRSMAVLRRCQESDREELNYWKRRYNENTELRKTGTELVSRQHSPGSADSLSNDSQREFNSRPGTGYVPVEFWKKTEEAVNKVKIQAMSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 19889 - protein, 614 aa, Homo sapiens
  Payload ID: 3968
  Gene Symbol: CBFA2T2
  Gene Name: core-binding factor, runt domain, alpha subunit 2
  translocated to, 2
  Uniprot ID: O43439
  ENSP ID: ENSP00000352622
MGFHHVGQARLELLTSGDLPALASQRAGITVGPEKRVPAMPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHALNCIMEMVEKTRRSMAVLRRCQESDREELNYWKRRYNENTELRKTGTELVSRQHSPGSADSLSNDSQREFNSRPGTGYVPVEFWKKTEEAVNKVKIQAMSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 19890 - protein, 604 aa, Homo sapiens; identical to SEQ ID NO: 19886
  Payload ID: 3968
  Gene Symbol: CBFA2T2
  Gene Name: core-binding factor, runt domain, alpha subunit 2
  translocated to, 2
  Uniprot ID: O43439
  ENSP ID: ENSP00000364428

SEQ ID NO: 19891 - protein, 575 aa, Homo sapiens
  Payload ID: 3968
  Gene Symbol: CBFA2T2
  Gene Name: core-binding factor, runt domain, alpha subunit 2
  translocated to, 2
  Uniprot ID: O43439
  ENSP ID: ENSP00000380902
MPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHALNCIMEMVEKTRRSMAVLRRCQESDREELNYWKRRYNENTELRKTGTELVSRQHSPGSADSLSNDSQREFNSRPGTGYVPVEFWKKTEEAVNKVKIQAMSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 19892 - protein, 575 aa, Homo sapiens; identical to SEQ ID NO: 19891
  Payload ID: 3968
  Gene Symbol: CBFA2T2
  Gene Name: core-binding factor, runt domain, alpha subunit 2
  translocated to, 2
  Uniprot ID: O43439
  ENSP ID: ENSP00000433270

SEQ ID NO: 19893 - protein, 152 aa, Homo sapiens
  Payload ID: 3968
  Gene Symbol: CBFA2T2
  Gene Name: core-binding factor, runt domain, alpha subunit 2
  translocated to, 2
  ENSP ID: ENSP00000443398
MSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 19894 - protein, 653 aa, Homo sapiens
  Payload ID: 3969
  Gene Symbol: CBFA2T3
  Gene Name: core-binding factor, runt domain, alpha subunit 2
  translocated to, 3
  Uniprot ID: O75081
  ENSP ID: ENSP00000268679
MPASRLRDRAASSASGSTCGSMSQTHPVLESGLLASAGCSAPRGPRKGGPAPVDRKAKASAMPDSPAEVKTQPRSTPPSMPPPPPAASQGATRPPSFTPHTHREDGPATLPHGRFHGCLKWSMVCLLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 19895 - protein, 567 aa, Homo sapiens
  Payload ID: 3969
  Gene Symbol: CBFA2T3
  Gene Name: core-binding factor, runt domain, alpha subunit 2
  translocated to, 3
  Uniprot ID: O75081
  ENSP ID: ENSP00000332122
MPDSPAEVKTQPRSTPPSMPPPPPAASQGATRPPSFTPHTLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 19896 - protein, 62 aa, Homo sapiens
  Payload ID: 3969
  Gene Symbol: CBFA2T3
  Gene Name: core-binding factor, runt domain, alpha subunit 2
  translocated to, 3
  ENSP ID: ENSP00000454609
MPDSPAEVKTQPRSTPPSMPPPPPAASQGATRPPSFTPHTHREDGPATLPHGRFHGCLKWSM

SEQ ID NO: 19897 - protein, 418 aa, Homo sapiens
  Payload ID: 3969
  Gene Symbol: CBFA2T3
  Gene Name: core-binding factor, runt domain, alpha subunit 2
  translocated to, 3
  ENSP ID: ENSP00000454851
MPDSPAEVKTQPRSTPPSMPPPPPAASQGATRPPSFTPHTHREDGPATLPHGRFHGCLKWSMVCLLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLGKHGLVCQEAWS

SEQ ID NO: 19898 - protein, 130 aa, Homo sapiens
  Payload ID: 3969
  Gene Symbol: CBFA2T3
  Gene Name: core-binding factor, runt domain, alpha subunit 2
  translocated to, 3
  ENSP ID: ENSP00000454872
MPASRLRDRAASSASGSTCGSMSQTHPVLESGLLASAGCSAPRGPRKGGPAPVDRKAKASAMPDSPAEVKTQPRSTPPSMPPPPPAASQGATRPPSFTPHTLMNGSSHSPTAINGAPCTPNGFSNGPATS

SEQ ID NO: 19899 - protein, 22 aa, Homo sapiens
  Payload ID: 3969
  Gene Symbol: CBFA2T3
  Gene Name: core-binding factor, runt domain, alpha subunit 2
  translocated to, 3
  ENSP ID: ENSP00000456102
MPDSPAEVKTQPRSTPPSMPPP

SEQ ID NO: 19900 - protein, 132 aa, Homo sapiens
  Payload ID: 3969
  Gene Symbol: CBFA2T3
  Gene Name: core-binding factor, runt domain, alpha subunit 2
  translocated to, 3
  ENSP ID: ENSP00000456717
MPDSPAEVKTQPRSTPPSMPPPPPAASQGATRPPSFTPHTHREDGPATLPHGRFHGCLKWSMVCLLMNGSSHSPTAINGAPCTPNGFSNGPATSSTASLSTQHLPPACGARQLSKLKRFLTTLQQFGSDISP

SEQ ID NO: 19901 - protein, 121 aa, Homo sapiens
  Payload ID: 3969
  Gene Symbol: CBFA2T3
  Gene Name: core-binding factor, runt domain, alpha subunit 2
  translocated to, 3
  ENSP ID: ENSP00000457410
MPDSPAEVKTQPRSTPPSMPPPPPAASQGATRPPSFTPHTLMNGSSHSPTAINGAPCTPNGFSNGPATSSTASLSTQHLPPACGARQLSKLKRFLTTLQQFGSDISPEIGERVRTLVLGLV

SEQ ID NO: 19902 - protein, 34 aa, Homo sapiens
  Payload ID: 3969
  Gene Symbol: CBFA2T3
  Gene Name: core-binding factor, runt domain, alpha subunit 2
  translocated to, 3
  ENSP ID: ENSP00000464125
  MOD_RES (1)..(1): Any amino acid
XGPEGPQLGKHGLVCQEAWSSERLVGQRLGAGRP

SEQ ID NO: 19903 - protein, 450 aa, Homo sapiens
  Payload ID: 3970
  Gene Symbol: CIR1
  Gene Name: corepressor interacting with RBPJ, 1
  Uniprot ID: Q86X95
  ENSP ID: ENSP00000339723
MGKSFANFMCKKDFHPASKSNIKKVWMAEQKISYDKKKQEELMQQYLKEQESYDNRLLMGDERVKNGLNFMYEAPPGAKKENKEKEETEGETEYKFEWQKGAPREKYAKDDMNIRDQPFGIQVRNVRCIKCHKWGHVNTDRECPLFGLSGINASSVPTDGSGPSMHPSELIAEMRNSGFALKRNVLGRNLTANDPSQEYVASEGEEDPEVEFLKSLTTKQKQKLLRKLDRLEKKKKKKDRKKKKFQKSRSKHKKHKSSSSSSSSSSSSSSTETSESSSESESNNKEKKIQRKKRKKNKCSGHNNSDSEEKDKSKKRKLHEELSSSHHNREKAKEKPRFLKHESSREDSKWSHSDSDKKSRTHKHSPEKRGSERKEGSSRSHGREERSRRSRSRSPGSYKQRETRKRAQRNPGEEQSRRNDSRSHGTDLYRGEKMYREHPGGTHTKVTQRE

SEQ ID NO: 19904 - protein, 96 aa, Homo sapiens
  Payload ID: 3970
  Gene Symbol: CIR1
  Gene Name: corepressor interacting with RBPJ, 1
  ENSP ID: ENSP00000367211
  MOD_RES (1)..(1): Any amino acid
XEWQKGAPREKYAKDDMNIRDQPFGIQVRNVRCIKCHKWGHVNTDRECPLFGLSGINASSVPTDGSGRAQWLTPVIPALWEAKAGGSFEVRSSRPA

SEQ ID NO: 19905 - protein, 1042 aa, Homo sapiens
  Payload ID: 3971
  Gene Symbol: CORIN
  Gene Name: corin, serine peptidase
  Uniprot ID: Q9Y5Q5
  ENSP ID: ENSP00000273857
MKQSPALAPEERCRRAGSPKPVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 19906 - protein, 734 aa, Homo sapiens
  Payload ID: 3971
  Gene Symbol: CORIN
  Gene Name: corin, serine peptidase
  ENSP ID: ENSP00000423216
MKQSPALAPEERCRRAGSPKPVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCACHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCGELLVSAICCTLSCLSATEAEWILNYFLDFTDQVHLFCFTVIKADSADLCVLFPTHRKFPHEATSLFEISILYGKTFGFKML

SEQ ID NO: 19907 - protein, 975 aa, Homo sapiens
  Payload ID: 3971
  Gene Symbol: CORIN
  Gene Name: corin, serine peptidase
  ENSP ID: ENSP00000424212
MKQSPALAPEERCRRAGSPKPVLRADDNNMGNGCSQKLATANLLRFLLLVLIPCICALVLLLVILLSYVGACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 19908 - protein, 1005 aa, Homo sapiens
  Payload ID: 3971
  Gene Symbol: CORIN
  Gene Name: corin, serine peptidase
  ENSP ID: ENSP00000425401
MKQSPALAPEERCRRAGSPKPVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCACHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 19909 - protein, 903 aa, Homo sapiens
  Payload ID: 3971
  Gene Symbol: CORIN
  Gene Name: corin, serine peptidase
  ENSP ID: ENSP00000425597
MNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 19910 - protein, 938 aa, Homo sapiens
  Payload ID: 3971
  Gene Symbol: CORIN
  Gene Name: corin, serine peptidase
  ENSP ID: ENSP00000484087
MKQSPALAPEERCRRAGSPKPVLRADDNNMGNGCSQKLATANLLRFLLLVLIPCICALVLLLVILLSYVGACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCACHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 19911 - protein, 528 aa, Homo sapiens
  Payload ID: 3972
  Gene Symbol: CDSN
  Gene Name: corneodesmosin
  Uniprot ID: Q15517
  ENSP ID: ENSP00000259726
MGSSRAPWMGRVGGHGMLALLLAGLLLPGTLAKSIGTFSDPCKDPTRITSPNDPCLTGKGDSSGFSSYSGSSSSGSSISSARSSGGGSSGSSSGSSIAQGGSAGSFKPGTGYSQVSYSSGSGSSLQGASGSSQLGSSSSHSGSSGSHSGSSSHSSSSSSFQFSSSSFQVGNGSALPTNDNSYRGILNPSQPGQSSSSSQTFGVSSSGQSVSSNQRPCSSDIPDSPCSGGPIVSHSGPYIPSSHSVSGGQRPVVVVVDQHGSGAPGVVQGPPCSNGGLPGKPCPPITSVDKSYGGYEVVGGSSDSYLVPGMTYSKGKIYPVGYFTKENPVKGSPGVPSFAAGPPISEGKYFSSNPIIPSQSAASSAIAFQPVGTGGVQLCGGGSTGSKGPCSPSSSRVPSSSSISSSSGLPYHPCGSASQSPCSPPGTGSFSSSSSSQSSGKIILQPCGSKSSSSGHPCMSVSSLTLTGGPDGSPHPDPSAGAKPCGSSSAGKIPCRSIRDILAQVKPLGPQLADPEVFLPQGELLDSP

SEQ ID NO: 19912 - protein, 529 aa, Homo sapiens
  Payload ID: 3972
  Gene Symbol: CDSN
  Gene Name: corneodesmosin
  ENSP ID: ENSP00000365465
MGSSRAPWMGRVGGHGMMALLLAGLLLPGTLAKSIGTFSDPCKDPTRITSPNDPCLTGKGDSSGFSSYSGSSSSGSSISSARSSGGGSSGSSSGSSIAQGGSAGSFKPGTGYSQVSYSSGSGSSLQGASGSSQLGSSSSHSGNSGSHSGSSSSHSSSSSSFQFSSSSFQVGNGSALPTNDNSYRGILNPSQPGQSSSSSQTFGVSSSGQSVSSNQRPCSSDIPDSPCSGGPIVSHSGPYIPSSHSVSGGQRPVVVVVDQHGSGAPGVVQGPPCSNGGLPGKPCPPITSVDKSYGGYEVVGGSSDSYLVPGMTYSKGKIYPVGYFTKENPVKGSPGVPSFAAGPPISEGKYFSSNPIIPSQSAASSAIAFQPVGTGGVQLCGGGSTGSKGPCSPSSSRVPSSSSISSSSGLPYHPCGSASQSPCSPPGTGSFSSSSSSQSSGKIILQPCGSKSSSSGHPCMSVSSLTLTGGPDGSPHPDPSAGAKPCGSSSAGKIPCRSIRDILAQVKPLGPQLADPEVFLPQGELLNSP

SEQ ID NO: 19913 - protein, 529 aa, Homo sapiens
  Payload ID: 3972
  Gene Symbol: CDSN
  Gene Name: corneodesmosin
  ENSP ID: ENSP00000373023
MGSSRAPWMGRVGGHGMMALLLAGLLLPGTLAKSIGTFSDPCKDPTRITSPNDPCLTGKGDSSGFSSYSGSSSSGSSISSARSSGGGSSGSSSGSSIAQGGSAGSFKPGTGYSQVSYSSGSGSSLQGASGSSQLGSSSSHSGSSGSHSGSSSSHSSSSSSFQFSSSSFQVGNGSALPTNDNSYRGILNPSQPGQSSSSSQTFGVSSSGQSVSSNQRPCSSDIPDSPCSGGPIVSHSGPYIPSSHSVSGGQRPVVVVVDQHGSGAPGVVQGPPCSNGGLPGKPCPPITSVDKSYGGYEVVGGSSDSYLVPGMTYSKGKIYPVGYFTKENPVKGSPGVPSFAAGPPISEGKYFSSNPIIPSQSAASSAIAFQPVGTGGVQLCGGGSTGSKGPCSPSSSRVPSSSSISSSAGSPYHPCGSASQSPCSPPGTGSFSSSSSSQSSGKIILQPCGSKSSSSGHPCMSVSSLTLTGGPDGSPHPDPSAGAKPCGSSSAGKIPCRSIRDILAQVKPLGPQLADPEVFLPQGELLDSP

SEQ ID NO: 19914 - protein, 529 aa, Homo sapiens
  Payload ID: 3972
  Gene Symbol: CDSN
  Gene Name: corneodesmosin
  Uniprot ID: Q15517
  ENSP ID: ENSP00000388386
MGSSRAPWMGRVGGHGMMALLLAGLLLPGTLAKSIGTFSDPCKDPTRITSPNDPCLTGKGDSSGFSSYSGSSSSGSSISSARSSGGGSSGSSSGSSIAQGGSAGSFKPGTGYSQVSYSSGSGSSLQGASGSSQLGSSSSHSGSSGSHSGSSSSHSSSSSSFQFSSSSFQVGNGSALPTNDNSYRGILNPSQPGQSSSSSQTSGVSSSGQSVSSNQRPCSSDIPDSPCSGGPIVSHSGPYIPSSHSVSGGQRPVVVVVDQHGSGAPGVVQGPPCSNGGLPGKPCPPITSVDKSYGGYEVVGGSSDSYLVPGMTYSKGKIYPVGYFTKENPVKGSPGVPSFAAGPPISEGKYFSSNPIIPSQSAASSAIAFQPVGTGGVQLCGGGSTGSKGPCSPSSSRVPSSSSISSSSGSPYHPCGSASQSPCSPPGTGSFSSSSSSQSSGKIILQPCGSKSSSSGHPCMSVSSLTLTGGPDGSPHPDPSAGAKPCGSSSAGKIPCRSIRDILAQVKPLGPQLADPEVFLPQGELLDSP

SEQ ID NO: 19915 - protein, 529 aa, Homo sapiens [sequence omitted]

SEQ ID NO: 19916 - protein, 529 aa, Homo sapiens; identical to SEQ ID NO: 19914
  Payload ID: 3972
  Gene Symbol: CDSN
  Gene Name: corneodesmosin
  Uniprot ID: Q15517
  ENSP ID: ENSP00000399604

SEQ ID NO: 19917 - protein, 144 aa, Homo sapiens
  Payload ID: 3973
  Gene Symbol: CNIH1
  Gene Name: cornichon family AMPA receptor auxiliary protein 1
  Uniprot ID: O95406
  ENSP ID: ENSP00000216416
MAFTFAAFCYMLALLLTAALIFFAIWHIIAFDELKTDYKNPIDQCNTLNPLVLPEYLIHAFFCVMFLCAAEWLTLGLNMPLLAYHIWRYMSRPVMSGPGLYDPTTIMNADILAYCQKEGWCKLAFYLLAFFYYLYGMIYVLVSS

SEQ ID NO: 19918 - protein, 96 aa, Homo sapiens
  Payload ID: 3973
  Gene Symbol: CNIH1
  Gene Name: cornichon family AMPA receptor auxiliary protein 1
  ENSP ID: ENSP00000378940
MAFTFAAFCYMLALLLTAALIFFAIWHIIAFDELKTDYKNPIDQCNTLNPLVLPEYLIHAFFCVMFLCAAEWLTLGLNMPLLAYHIWSMIYVLVSS

SEQ ID NO: 19919 - protein, 136 aa, Homo sapiens
  Payload ID: 3973
  Gene Symbol: CNIH1
  Gene Name: cornichon family AMPA receptor auxiliary protein 1
  ENSP ID: ENSP00000451142
MAFTFAAFCYMLALLLTAALIFFAIWHIIAFDELKTDYKNPIDQCNTLNPLVLPEYLIHAFFCVMFLCAAEWLTLGLNMPLLAYHIWRYMSRPVMSGPGLYDPTTIMNADILAYCQKEGWCKLAFYLLAFFYYLYG

SEQ ID NO: 19920 - protein, 53 aa, Homo sapiens
  Payload ID: 3973
  Gene Symbol: CNIH1
  Gene Name: cornichon family AMPA receptor auxiliary protein 1
  ENSP ID: ENSP00000451640
MAFTFAAFCYMLALLLTAALIFFAIWHIIAFDELKTDYKNPIDQCNTLNPVYE

SEQ ID NO: 19921 - protein, 160 aa, Homo sapiens
  Payload ID: 3973
  Gene Symbol: CNIH1
  Gene Name: cornichon family AMPA receptor auxiliary protein 1
  ENSP ID: ENSP00000451852
MAFTFAAFCYMLALLLTAALIFFAIWHIIAFDELKTDYKNPIDQCNTLNPTVEKVKKIKRVKIALKLVLPEYLIHAFFCVMFLCAAEWLTLGLNMPLLAYHIWRYMSRPVMSGPGLYDPTTIMNADILAYCQKEGWCKLAFYLLAFFYYLYGMIYVLVSS

SEQ ID NO: 19922 - protein, 121 aa, Homo sapiens
  Payload ID: 3973
  Gene Symbol: CNIH1
  Gene Name: cornichon family AMPA receptor auxiliary protein 1
  ENSP ID: ENSP00000452457
MAFTFAAFCYMLALLLTAALIFFAIWHLVLPEYLIHAFFCVMFLCAAEWLTLGLNMPLLAYHIWRYMSRPVMSGPGLYDPTTIMNADILAYCQKEGWCKLAFYLLAFFYYLYGMIYVLVSS

SEQ ID NO: 19923 - protein, 33 aa, Homo sapiens
  Payload ID: 3973
  Gene Symbol: CNIH1
  Gene Name: cornichon family AMPA receptor auxiliary protein 1
  ENSP ID: ENSP00000452466
MAFTFAAFCYMLALLLTAALIFFAIWHDKEEFG

SEQ ID NO: 19924 - protein, 160 aa, Homo sapiens
  Payload ID: 3974
  Gene Symbol: CNIH2
  Gene Name: cornichon family AMPA receptor auxiliary protein 2
  Uniprot ID: Q6PI25
  ENSP ID: ENSP00000310003
MAFTFAAFCYMLTLVLCASLIFFVIWHIIAFDELRTDFKNPIDQGNPARARERLKNIERICCLLRKLVVPEYSIHGLFCLMFLCAAEWVTLGLNIPLLFYHLWRYFHRPADGSEVMYDAVSIMNADILNYCQKESWCKLAFYLLSFFYYLYSMVYTLVSF

SEQ ID NO: 19925 - protein, 152 aa, Homo sapiens
  Payload ID: 3974
  Gene Symbol: CNIH2
  Gene Name: cornichon family AMPA receptor auxiliary protein 2
  ENSP ID: ENSP00000432177
MAFTFAAFCYMLTLVLCASLIFFVIWHIIAFDELRTDFKNPIDQGNPARARERLKNIERICCLLRKLVVPEYSIHGLFCLMFLCAAEWVTLGLNIPLLFYHLWRYFHRPADGSEVMYDAVSIMNADILNYCQKESWCKLAFYLLSFFYYLYR

SEQ ID NO: 19926 - protein, 39 aa, Homo sapiens
  Payload ID: 3974
  Gene Symbol: CNIH2
  Gene Name: cornichon family AMPA receptor auxiliary protein 2
  ENSP ID: ENSP00000433896
MAFTFAAFCYMLTLVLCASLIFFVIWHEKHHLDLSCDCQ

SEQ ID NO: 19927 - protein, 62 aa, Homo sapiens
  Payload ID: 3974
  Gene Symbol: CNIH2
  Gene Name: cornichon family AMPA receptor auxiliary protein 2
  ENSP ID: ENSP00000435537
MAFTFAAFCYMLTLVLCASLIFFVIWHIIAFDELRTDFKNPIDQGNPARAVSDTCAVPSASV

SEQ ID NO: 19928 - protein, 160 aa, Homo sapiens
  Payload ID: 3975
  Gene Symbol: CNIH3
  Gene Name: cornichon family AMPA receptor auxiliary protein 3
  Uniprot ID: Q8TBE1
  ENSP ID: ENSP00000272133
MAFTFAAFCYMLSLVLCAALIFFAIWHIIAFDELRTDFKSPIDQCNPVHARERLRNIERICFLLRKLVLPEYSIHSLFCIMFLCAQEWLTLGLNVPLLFYHFWRYFHCPADSSELAYDPPVVMNADTLSYCQKEAWCKLAFYLLSFFYYLYCMIYTLVSS

SEQ ID NO: 19929 - protein, 137 aa, Homo sapiens
  Payload ID: 3976
  Gene Symbol: CNIH4
  Gene Name: cornichon family AMPA receptor auxiliary protein 4
  ENSP ID: ENSP00000355821
MEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLGFHLLCFFMYLYSGSNCPC

SEQ ID NO: 19930 - protein, 92 aa, Homo sapiens
  Payload ID: 3976
  Gene Symbol: CNIH4
  Gene Name: cornichon family AMPA receptor auxiliary protein 4
  Uniprot ID: Q9P003
  ENSP ID: ENSP00000355822
MEAVVFVFSLLDCCALIFLSVYFIITLSDLECDYINARSCCSKLNKWVIPELIGHTIVTVLLLMSLHWFIFLLNLPVATWNIYRMILALIND

SEQ ID NO: 19931 - protein, 90 aa, Homo sapiens
  Payload ID: 3976
  Gene Symbol: CNIH4
  Gene Name: cornichon family AMPA receptor auxiliary protein 4
  ENSP ID: ENSP00000355823
MEAVVFVFSLLDCCALIFLSVYFIITLSDLECDYINARSCCSKLNKWVIPELIGHTIVTVLLLMSLHWFIFLLNLPVATWNIYRGSNCPC

SEQ ID NO: 19932 - protein, 139 aa, Homo sapiens
  Payload ID: 3976
  Gene Symbol: CNIH4
  Gene Name: cornichon family AMPA receptor auxiliary protein 4
  Uniprot ID: Q9P003
  ENSP ID: ENSP00000420443
MEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLGFHLLCFFMYLYSMILALIND

SEQ ID NO: 19933 - protein, 112 aa, Homo sapiens
  Payload ID: 3977
  Gene Symbol: CNFN
  Gene Name: cornifelin
  Uniprot ID: Q9BYD5
  ENSP ID: ENSP00000222032
MSYPVTSQPQCATTSCYQTQLSDWHTGLTDCCNDMPVCLCGTFAPLCLACRISDDFGECCCAPYLPGGLHSIRTGMRERYHIQGSVGHDWAALTFCLPCALCQMARELKIRE

SEQ ID NO: 19934 - protein, 112 aa, Homo sapiens; identical to SEQ ID NO: 19933
  Payload ID: 3977
  Gene Symbol: CNFN
  Gene Name: cornifelin
  Uniprot ID: Q9BYD5
  ENSP ID: ENSP00000469590

SEQ ID NO: 19935 - protein, 495 aa, Homo sapiens
  Payload ID: 3978
  Gene Symbol: CRNN
  Gene Name: cornulin
  Uniprot ID: Q9UBG3
  ENSP ID: ENSP00000271835
MPQLLQNINGIIEAFRRYARTEGNCTALTRGELKRLLEQEFADVIVKPHDPATVDEVLRLLDEDHTGTVEFKEFLVLVFKVAQACFKTLSESAEGACGSQESGSLHSGASQELGEGQRSGTEVGRAGKGQHYEGSSHRQSQQGSRGQNRPGVQTQGQATGSAWVSSYDRQAESQSQERISPQIQLSGQTEQTQKAGEGKRNQTTEMRPERQPQTREQDRAHQTGETVTGSGTQTQAGATQTVEQDSSHQTGRTSKQTQEATNDQNRGTETHGQGRSQTSQAVTGGHAQIQAGTHTQTPTQTVEQDSSHQTGSTSTQTQESTNGQNRGTEIHGQGRSQTSQAVTGGHTQIQAGSHTETVEQDRSQTVSHGGAREQGQTQTQPGSGQRWMQVSNPEAGETVPGGQAQTGASTESGRQEWSSTHPRRCVTEGQGDRQPTVVGEEWVDDHSRETVILRLDQGNLHTSVSSAQGQDAAQSEEKRGITARELYSYLRSTKP

SEQ ID NO: 19936 - protein, 535 aa, Homo sapiens
  Payload ID: 3979
  Gene Symbol: CORO7-PAM16
  Gene Name: CORO7-PAM16 readthrough
  ENSP ID: ENSP00000458607
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLEMREKRHREV

SEQ ID NO: 19937 - protein, 1048 aa, Homo sapiens
  Payload ID: 3979
  Gene Symbol: CORO7-PAM16
  Gene Name: CORO7-PAM16 readthrough
  ENSP ID: ENSP00000460885
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWAKYLAQIIVMGVQVVGRAFARALRQEFAASRAAADARGRAGHRSAAASNLSGLSLQEAQQILNVSKLSPEEVQKNYEHLFKVNDKSVGGSFYLQSKVVRAKERLDEELKIQAQEDREKGQMPHT

SEQ ID NO: 19938 - protein, 1048 aa, Homo sapiens; identical to SEQ ID NO: 19937
  Payload ID: 3979
  Gene Symbol: CORO7-PAM16
  Gene Name: CORO7-PAM16 readthrough
  ENSP ID: ENSP00000480927

SEQ ID NO: 19939 - protein, 535 aa, Homo sapiens; identical to SEQ ID NO: 19936
  Payload ID: 3979
  Gene Symbol: CORO7-PAM16
  Gene Name: CORO7-PAM16 readthrough
  ENSP ID: ENSP00000488813

SEQ ID NO: 19940 - protein, 472 aa, Homo sapiens
  Payload ID: 3980
  Gene Symbol: CORO6
  Gene Name: coronin 6
  Uniprot ID: Q6QEF8
  ENSP ID: ENSP00000344562
MSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVAERFAAHEGMRPMRAVFTRQGHIFTTGFTRMSQRELGLWDPNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQQHTLETLLEEIKALRERVQAQEQRITALENMLCELVDGTD

SEQ ID NO: 19941 - protein, 472 aa, Homo sapiens; identical to SEQ ID NO: 19940
  Payload ID: 3980
  Gene Symbol: CORO6
  Gene Name: coronin 6
  Uniprot ID: Q6QEF8
  ENSP ID: ENSP00000373419

SEQ ID NO: 19942 - protein, 471 aa, Homo sapiens
  Payload ID: 3980
  Gene Symbol: CORO6
  Gene Name: coronin 6
  ENSP ID: ENSP00000462627
MSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVAEQARPHEGARPLRAVFTADGKLLSTGFSRMSERQLALWDPNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 19943 - protein, 432 aa, Homo sapiens
  Payload ID: 3980
  Gene Symbol: CORO6
  Gene Name: coronin 6
  ENSP ID: ENSP00000463723
MSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVANNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQQHTLETLLEEIKALRERVQAQEQRITALENMLCELVDGTD

SEQ ID NO: 19944 - protein, 198 aa, Homo sapiens
  Payload ID: 3980
  Gene Symbol: CORO6
  Gene Name: coronin 6
  ENSP ID: ENSP00000464396
MSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKT

SEQ ID NO: 19945 - protein, 29 aa, Homo sapiens
  Payload ID: 3980
  Gene Symbol: CORO6
  Gene Name: coronin 6
  ENSP ID: ENSP00000464621
  MOD_RES (1)..(1): Any amino acid
XADGKLLSTGFSRMSERQLALWDPFCCVA

SEQ ID NO: 19946 - protein, 74 aa, Homo sapiens
  Payload ID: 3980
  Gene Symbol: CORO6
  Gene Name: coronin 6
  ENSP ID: ENSP00000468235
MVWQIPDYTPMRNITEPIITLEGHSKRVGILSWHPTARNVLLSAGGDNVIIIWNVGTGEVLLSLDDMHPDVIHS

SEQ ID NO: 19947 - protein, 925 aa, Homo sapiens
  Payload ID: 3981
  Gene Symbol: CORO7
  Gene Name: coronin 7
  Uniprot ID: P57737
  ENSP ID: ENSP00000251166
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWD

SEQ ID NO: 19948 - protein, 907 aa, Homo sapiens
  Payload ID: 3981
  Gene Symbol: CORO7
  Gene Name: coronin 7
  Uniprot ID: P57737
  ENSP ID: ENSP00000440460
MNRFRVSKFRHTEARPPRRESWISDIRAGTAPSCRNHIKSSCSLIAFNSDRPGVLGIVPLQGQGEDKRRVAHLGCHSGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWD

SEQ ID NO: 19949 - protein, 161 aa, Homo sapiens
  Payload ID: 3981
  Gene Symbol: CORO7
  Gene Name: coronin 7
  ENSP ID: ENSP00000458411
MNRFRVSKFRHTEARPPRREDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLR

SEQ ID NO: 19950 - protein, 46 aa, Homo sapiens
  Payload ID: 3981
  Gene Symbol: CORO7
  Gene Name: coronin 7
  ENSP ID: ENSP00000458459
MNRFRVSKFRHTEARPPRREPEQVEPQRIAEPGAGRPFGPPKRQED

SEQ ID NO: 19951 - protein, 219 aa, Homo sapiens
  Payload ID: 3981
  Gene Symbol: CORO7
  Gene Name: coronin 7
  ENSP ID: ENSP00000458828
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILSWQPMGTWCRAPSGAEMEPWWARRARTSSCGSLTPEQSRGPLRARRPMRTAGIAGWHGWAPGSTLCLLDSTRCVSAK

SEQ ID NO: 19952 - protein, 161 aa, Homo sapiens
  Payload ID: 3981
  Gene Symbol: CORO7
  Gene Name: coronin 7
  ENSP ID: ENSP00000458935
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILSWQPMGTWCRAPSGAEMEP

SEQ ID NO: 19953 - protein, 57 aa, Homo sapiens
  Payload ID: 3981
  Gene Symbol: CORO7
  Gene Name: coronin 7
  ENSP ID: ENSP00000459085
MGTWCRAPSGAEMEPWWARRARTSSCGSLTPEQSRGPLRARRPMRTAGIAGWHGWAP

SEQ ID NO: 19954 - protein, 108 aa, Homo sapiens
  Payload ID: 3981
  Gene Symbol: CORO7
  Gene Name: coronin 7
  ENSP ID: ENSP00000459228
MGTWCRAPSGAEMEPWWARRARTSSCGSLTPEQSRGPLRALSCTETATSPTSRGSTSPHLVRVTASVPTSCVWPCRCSAAGDRWLCLSYGSLAACPTRHCPRCRMGQL

SEQ ID NO: 19955 - protein, 205 aa, Homo sapiens
  Payload ID: 3981
  Gene Symbol: CORO7
  Gene Name: coronin 7
  ENSP ID: ENSP00000459286
MLQPRPHASKHRRRRGLTAAPHVTSHPRQSVPSDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDT

SEQ ID NO: 19956 - protein, 19 aa, Homo sapiens
  Payload ID: 3981
  Gene Symbol: CORO7
  Gene Name: coronin 7
  ENSP ID: ENSP00000459401
MNRFRVSKFRHTEARPPRR

SEQ ID NO: 19957 - protein, 11 aa, Homo sapiens
  Payload ID: 3981
  Gene Symbol: CORO7
  Gene Name: coronin 7
  ENSP ID: ENSP00000459888
MGTWCRAPSGA

SEQ ID NO: 19958 - protein, 156 aa, Homo sapiens
  Payload ID: 3981
  Gene Symbol: CORO7
  Gene Name: coronin 7
  ENSP ID: ENSP00000460036
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQAHENSRDSRLAWMGTWEHLVSTGFNQMREREVKLWDTRFFSSAL

SEQ ID NO: 19959 - protein, 119 aa, Homo sapiens
  Payload ID: 3981
  Gene Symbol: CORO7
  Gene Name: coronin 7
  ENSP ID: ENSP00000460177
  MOD_RES (1)..(1): Any amino acid
XCSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVR

SEQ ID NO: 19960 - protein, 114 aa, Homo sapiens
  Payload ID: 3981
  Gene Symbol: CORO7
  Gene Name: coronin 7
  ENSP ID: ENSP00000460199
MNRFRVSKFRHTEARPPRRESWISDIRAGTAPSCRNHIKSSCSLIAFNSDRPGVLGIVPLQGQGEDKRRVAHLGCHSELAAHGDLVQSAVWSRDGALVGTACKTESQSVSQAGV

SEQ ID NO: 19961 - protein, 47 aa, Homo sapiens
  Payload ID: 3981
  Gene Symbol: CORO7
  Gene Name: coronin 7
  ENSP ID: ENSP00000460901
MGTWCRAPSGAEMEPWWARRARTSSCGSLTPEQSRGPLRARRPMRTA

SEQ ID NO: 19962 - protein, 206 aa, Homo sapiens
  Payload ID: 3981
  Gene Symbol: CORO7
  Gene Name: coronin 7
  ENSP ID: ENSP00000460910
MLQPRPHASKHRRRRGLTAAPHVTSHPRQSVPSSWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLR

SEQ ID NO: 19963 - protein, 190 aa, Homo sapiens
  Payload ID: 3981
  Gene Symbol: CORO7
  Gene Name: coronin 7
  ENSP ID: ENSP00000460956
VREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWVSSEWPHFPAGSAVPRTCHGACLLPSQALLTPSHLLVFRPRTSLRPRHLHLTCAATS

SEQ ID NO: 19964 - protein, 46 aa, Homo sapiens
  Payload ID: 3981
  Gene Symbol: CORO7
  Gene Name: coronin 7
  ENSP ID: ENSP00000461051
MNRFRVSKFRHTEARPPRREVYWALCLCKAKERTSDAWPTWAAIQT

SEQ ID NO: 19965 - protein, 367 aa, Homo sapiens
  Payload ID: 3981
  Gene Symbol: CORO7
  Gene Name: coronin 7
  ENSP ID: ENSP00000461187
MNRFRVSKFRHTEARPPRREDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLEMREKRHREV

SEQ ID NO: 19966 - protein, 840 aa, Homo sapiens
  Payload ID: 3981
  Gene Symbol: CORO7
  Gene Name: coronin 7
  Uniprot ID: P57737
  ENSP ID: ENSP00000461702
MNRFRVSKFRHTEARPPRRESWISDIRAGTAPSCRNHIKSSCSLIAFNSDRPGVLGIVPLQGQGEDKRRVAHLGCHSELAAHGDLVQSAVWSRDGALVGTACKDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWD

SEQ ID NO: 19967 - protein, 201 aa, Homo sapiens
  Payload ID: 3981
  Gene Symbol: CORO7
  Gene Name: coronin 7
  ENSP ID: ENSP00000461797
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILSWQPMGTWCRAPSGAEMEPWWARRARTSSCGSLTPEQSRGPLRARRPMRTAGIAGWHGW

SEQ ID NO: 19968 - protein, 925 aa, Homo sapiens; identical to SEQ ID NO: 19947
  Payload ID: 3981
  Gene Symbol: CORO7
  Gene Name: coronin 7
  Uniprot ID: P57737
  ENSP ID: ENSP00000482646

SEQ ID NO: 19969 - protein, 907 aa, Homo sapiens; identical to SEQ ID NO: 19948
  Payload ID: 3981
  Gene Symbol: CORO7
  Gene Name: coronin 7
  Uniprot ID: P57737
  ENSP ID: ENSP00000483187

SEQ ID NO: 19970 - protein, 156 aa, Homo sapiens; identical to SEQ ID NO: 19958
  Payload ID: 3981
  Gene Symbol: CORO7
  Gene Name: coronin 7
  ENSP ID: ENSP00000487636

SEQ ID NO: 19971 - protein, 119 aa, Homo sapiens; identical to SEQ ID NO: 19959
  Payload ID: 3981
  Gene Symbol: CORO7
  Gene Name: coronin 7
  ENSP ID: ENSP00000487652
  MOD_RES (1)..(1): Any amino acid

SEQ ID NO: 19972 - protein, 108 aa, Homo sapiens; identical to SEQ ID NO: 19954
  Payload ID: 3981
  Gene Symbol: CORO7
  Gene Name: coronin 7
  ENSP ID: ENSP00000487794

SEQ ID NO: 19973 - protein, 206 aa, Homo sapiens; identical to SEQ ID NO: 19962
  Payload ID: 3981
  Gene Symbol: CORO7
  Gene Name: coronin 7
  ENSP ID: ENSP00000487921

SEQ ID NO: 19974 - protein, 161 aa, Homo sapiens; identical to SEQ ID NO: 19949
  Payload ID: 3981
  Gene Symbol: CORO7
  Gene Name: coronin 7
  ENSP ID: ENSP00000487981

SEQ ID NO: 19975 - protein, 46 aa, Homo sapiens; identical to SEQ ID NO: 19950
  Payload ID: 3981
  Gene Symbol: CORO7
  Gene Name: coronin 7
  ENSP ID: ENSP00000488061

SEQ ID NO: 19976 - protein, 114 aa, Homo sapiens; identical to SEQ ID NO: 19960
  Payload ID: 3981
  Gene Symbol: CORO7
  Gene Name: coronin 7
  ENSP ID: ENSP00000488122

SEQ ID NO: 19977 - protein, 46 aa, Homo sapiens; identical to SEQ ID NO: 19964
  Payload ID: 3981
  Gene Symbol: CORO7
  Gene Name: coronin 7
  ENSP ID: ENSP00000488149

SEQ ID NO: 19978 - protein, 219 aa, Homo sapiens; identical to SEQ ID NO: 19951
  Payload ID: 3981
  Gene Symbol: CORO7
  Gene Name: coronin 7
  ENSP ID: ENSP00000488164

SEQ ID NO: 19979 - protein, 47 aa, Homo sapiens; identical to SEQ ID NO: 19961
  Payload ID: 3981
  Gene Symbol: CORO7
  Gene Name: coronin 7
  ENSP ID: ENSP00000488250

SEQ ID NO: 19980 - protein, 161 aa, Homo sapiens; identical to SEQ ID NO: 19952
  Payload ID: 3981
  Gene Symbol: CORO7
  Gene Name: coronin 7
  ENSP ID: ENSP00000488278

SEQ ID NO: 19981 - protein, 201 aa, Homo sapiens; identical to SEQ ID NO: 19967
  Payload ID: 3981
  Gene Symbol: CORO7
  Gene Name: coronin 7
  ENSP ID: ENSP00000488375

SEQ ID NO: 19982 - protein, 367 aa, Homo sapiens; identical to SEQ ID NO: 19965
  Payload ID: 3981
  Gene Symbol: CORO7
  Gene Name: coronin 7
  ENSP ID: ENSP00000488416

SEQ ID NO: 19983 - protein, 11 aa, Homo sapiens
  Payload ID: 3981
  Gene Symbol: CORO7
  Gene Name: coronin 7
  ENSP ID: ENSP00000488425
MGTWCRAPSGA

SEQ ID NO: 19984 - protein, 205 aa, Homo sapiens; identical to SEQ ID NO: 19955
  Payload ID: 3981
  Gene Symbol: CORO7
  Gene Name: coronin 7
  ENSP ID: ENSP00000488426

SEQ ID NO: 19985 - protein, 57 aa, Homo sapiens; identical to SEQ ID NO: 19953
  Payload ID: 3981
  Gene Symbol: CORO7
  Gene Name: coronin 7
  ENSP ID: ENSP00000488553

SEQ ID NO: 19986 - protein, 19 aa, Homo sapiens
  Payload ID: 3981
  Gene Symbol: CORO7
  Gene Name: coronin 7
  ENSP ID: ENSP00000488571
MNRFRVSKFRHTEARPPRR

SEQ ID NO: 19987 - protein, 190 aa, Homo sapiens; identical to SEQ ID NO: 19963
  Payload ID: 3981
  Gene Symbol: CORO7
  Gene Name: coronin 7
  ENSP ID: ENSP00000488658

SEQ ID NO: 19988 - protein, 840 aa, Homo sapiens; identical to SEQ ID NO: 19966
  Payload ID: 3981
  Gene Symbol: CORO7
  Gene Name: coronin 7
  Uniprot ID: P57737
  ENSP ID: ENSP00000488867

SEQ ID NO: 19989 - protein, 461 aa, Homo sapiens
  Payload ID: 3982
  Gene Symbol: CORO1A
  Gene Name: coronin, actin binding protein, 1A
  Uniprot ID: P31146
  ENSP ID: ENSP00000219150
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 19990 - protein, 148 aa, Homo sapiens
  Payload ID: 3982
  Gene Symbol: CORO1A
  Gene Name: coronin, actin binding protein, 1A
  ENSP ID: ENSP00000454752
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLL

SEQ ID NO: 19991 - protein, 461 aa, Homo sapiens; identical to SEQ ID NO: 19989
  Payload ID: 3982
  Gene Symbol: CORO1A
  Gene Name: coronin, actin binding protein, 1A
  Uniprot ID: P31146
  ENSP ID: ENSP00000455552

SEQ ID NO: 19992 - protein, 249 aa, Homo sapiens
  Payload ID: 3982
  Gene Symbol: CORO1A
  Gene Name: coronin, actin binding protein, 1A
  ENSP ID: ENSP00000456266
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVAL

SEQ ID NO: 19993 - protein, 389 aa, Homo sapiens
  Payload ID: 3982
  Gene Symbol: CORO1A
  Gene Name: coronin, actin binding protein, 1A
  ENSP ID: ENSP00000456457
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKDAVSRLEEEMRKLQATVQELQKRLDRLEETVQAK

SEQ ID NO: 19994 - protein, 218 aa, Homo sapiens
  Payload ID: 3982
  Gene Symbol: CORO1A
  Gene Name: coronin, actin binding protein, 1A
  ENSP ID: ENSP00000456756
MPDYFSRRAGVFPMKPGDPGRRSDSRGHPCLDLRARMSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSV

SEQ ID NO: 19995 - protein, 246 aa, Homo sapiens
  Payload ID: 3982
  Gene Symbol: CORO1A
  Gene Name: coronin, actin binding protein, 1A
  ENSP ID: ENSP00000457332
MSRQVVRSSKFRHVFGQPAKADQCYEDVRVSQTTWDSGFCAVNPKFVALICEASGGGAFLVLPLGKVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGK

SEQ ID NO: 19996 - protein, 165 aa, Homo sapiens
  Payload ID: 3982
  Gene Symbol: CORO1A
  Gene Name: coronin, actin binding protein, 1A
  ENSP ID: ENSP00000457509
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGA

SEQ ID NO: 19997 - protein, 489 aa, Homo sapiens
  Payload ID: 3983
  Gene Symbol: CORO1B
  Gene Name: coronin, actin binding protein, 1B
  Uniprot ID: Q9BR76
  ENSP ID: ENSP00000340211
MSFRKVVRQSKFRHVFGQPVKNDQCYEDIRVSRVTWDSTFCAVNPKFLAVIVEASGGGAFLVLPLSKTGRIDKAYPTVCGHTGPVLDIDWCPHNDEVIASGSEDCTVMVWQIPENGLTSPLTEPVVVLEGHTKRVGIIAWHPTARNVLLSAGCDNVVLIWNVGTAEELYRLDSLHPDLIYNVSWNHNGSLFCSACKDKSVRIIDPRRGTLVAEREKAHEGARPMRAIFLADGKVFTTGFSRMSERQLALWDPENLEEPMALQELDSSNGALLPFYDPDTSVVYVCGKGDSSIRYFEITEEPPYIHFLNTFTSKEPQRGMGSMPKRGLEVSKCEIARFYKLHERKCEPIVMTVPRKSDLFQDDLYPDTAGPEAALEAEEWVSGRDADPILISLREAYVPSKQRDLKISRRNVLSDSRPAMAPGSSHLGAPASTTTAADATPSGSLARAGEAGKLEEVMQELRALRALVKEQGDRICRLEEQLGRMENGDA

SEQ ID NO: 19998 - protein, 489 aa, Homo sapiens; identical to SEQ ID NO: 19997
  Payload ID: 3983
  Gene Symbol: CORO1B
  Gene Name: coronin, actin binding protein, 1B
  Uniprot ID: Q9BR76
  ENSP ID: ENSP00000377471

SEQ ID NO: 19999 - protein, 139 aa, Homo sapiens
  Payload ID: 3983
  Gene Symbol: CORO1B
  Gene Name: coronin, actin binding protein, 1B
  ENSP ID: ENSP00000438056
MSFRKVVRQSKFRHVFGQPVKNDQCYEDIRVSRVTWDSTFCAVNPKFLAVIVEASGGGAFLVLPLSKTGRIDKAYPTVCGHTGPVLDIDWCPHNDEVIASGSEDCTVMVWQIPENGLTSPLTEPVVVLEGHTKRVGIIA

SEQ ID NO: 20000 - protein, 282 aa, Homo sapiens
  Payload ID: 3983
  Gene Symbol: CORO1B
  Gene Name: coronin, actin binding protein, 1B
  ENSP ID: ENSP00000445330
MSFRKVVRQSKFRHVFGQPVKNDQCYEDIRVSRVTWDSTFCAVNPKFLAVIVEASGGGAFLVLPLSKTGRIDKAYPTVCGHTGPVLDIDWCPHNDEVIASGSEDCTVMVWQIPENGLTSPLTEPVVVLEGHTKRVGIIAWHPTARNVLLSAGCDNVVLIWNVGTAEELYRLDSLHPDLIYNVSWNHNGSLFCSACKDKSVRIIDPRRGTLVAEREKAHEGARPMRAIFLADGKVFTTGFSRMSERQLALWDPGSPLLQKASSSSKPPGPSPLCFCIVTSRAP

SEQ ID NO: 20001 - protein, 260 aa, Homo sapiens
  Payload ID: 3983
  Gene Symbol: CORO1B
  Gene Name: coronin, actin binding protein, 1B
  ENSP ID: ENSP00000479949
MSFRKVVRQSKFRHVFGQPVKNDQCYEDIRVSRVTWDSTFCAVNPKFLAVIVEASGGGAFLVLPLSKTGRIDKAYPTVCGHTGPVLDIDWCPHNDEVIASGSEDCTVMVWQIPENGLTSPLTEPVVVLEGHTKRVGIIAWHPTARNVLLSAGCDNVVLIWNVGTAEELYRLDSLHPDLIYNVSWNHNGSLFCSACKDKSVRIIDPRRGTLVAEREKAHEGARPMRAIFLADGKVFTTGFSRMSERQLALWDPGVRRFCLA

SEQ ID NO: 20002 - protein, 282 aa, Homo sapiens; identical to SEQ ID NO: 20000
  Payload ID: 3983
  Gene Symbol: CORO1B
  Gene Name: coronin, actin binding protein, 1B
  ENSP ID: ENSP00000486585

SEQ ID NO: 20003 - protein, 474 aa, Homo sapiens
  Payload ID: 3984
  Gene Symbol: CORO1C
  Gene Name: coronin, actin binding protein, 1C
  Uniprot ID: Q9ULV4
  ENSP ID: ENSP00000261401
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 20004 - protein, 527 aa, Homo sapiens
  Payload ID: 3984
  Gene Symbol: CORO1C
  Gene Name: coronin, actin binding protein, 1C
  Uniprot ID: Q9ULV4
  ENSP ID: ENSP00000394496
MYGPGSQLGKSGNNSWAKERGCSIACQGSLTSARLHAPSIGERPLSHMRWKDTMRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 20005 - protein, 369 aa, Homo sapiens
  Payload ID: 3984
  Gene Symbol: CORO1C
  Gene Name: coronin, actin binding protein, 1C
  ENSP ID: ENSP00000415554
MVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 20006 - protein, 474 aa, Homo sapiens; identical to SEQ ID NO: 20003
  Payload ID: 3984
  Gene Symbol: CORO1C
  Gene Name: coronin, actin binding protein, 1C
  Uniprot ID: Q9ULV4
  ENSP ID: ENSP00000438341

SEQ ID NO: 20007 - protein, 151 aa, Homo sapiens
  Payload ID: 3984
  Gene Symbol: CORO1C
  Gene Name: coronin, actin binding protein, 1C
  ENSP ID: ENSP00000447049
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGG

SEQ ID NO: 20008 - protein, 165 aa, Homo sapiens
  Payload ID: 3984
  Gene Symbol: CORO1C
  Gene Name: coronin, actin binding protein, 1C
  ENSP ID: ENSP00000447337
SKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 20009 - protein, 480 aa, Homo sapiens
  Payload ID: 3984
  Gene Symbol: CORO1C
  Gene Name: coronin, actin binding protein, 1C
  Uniprot ID: Q9ULV4
  ENSP ID: ENSP00000447534
MRWKDTMRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 20010 - protein, 169 aa, Homo sapiens
  Payload ID: 3984
  Gene Symbol: CORO1C
  Gene Name: coronin, actin binding protein, 1C
  ENSP ID: ENSP00000447989
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINL

SEQ ID NO: 20011 - protein, 159 aa, Homo sapiens
  Payload ID: 3984
  Gene Symbol: CORO1C
  Gene Name: coronin, actin binding protein, 1C
  ENSP ID: ENSP00000448130
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAEKYAGTNCSS

SEQ ID NO: 20012 - protein, 162 aa, Homo sapiens
  Payload ID: 3984
  Gene Symbol: CORO1C
  Gene Name: coronin, actin binding protein, 1C
  ENSP ID: ENSP00000448195
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGT

SEQ ID NO: 20013 - protein, 163 aa, Homo sapiens
  Payload ID: 3984
  Gene Symbol: CORO1C
  Gene Name: coronin, actin binding protein, 1C
  ENSP ID: ENSP00000448527
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTG

SEQ ID NO: 20014 - protein, 181 aa, Homo sapiens
  Payload ID: 3984
  Gene Symbol: CORO1C
  Gene Name: coronin, actin binding protein, 1C
  ENSP ID: ENSP00000449330
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVS

SEQ ID NO: 20015 - protein, 125 aa, Homo sapiens
  Payload ID: 3984
  Gene Symbol: CORO1C
  Gene Name: coronin, actin binding protein, 1C
  ENSP ID: ENSP00000449658
MVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADG

SEQ ID NO: 20016 - protein, 525 aa, Homo sapiens
  Payload ID: 3985
  Gene Symbol: CORO2A
  Gene Name: coronin, actin binding protein, 2A
  Uniprot ID: Q92828
  ENSP ID: ENSP00000343746
MSWHPQYRSSKFRHVFGKPASKENCYDSVPITRSVHDNHFCAVNPHFIAVVTECAGGGAFLVIPLHQTGKLDPHYPKVCGHRGNVLDVKWNPFDDFEIASCSEDATIKIWSIPKQLLTRNLTAYRKELVGHARRVGLVEWHPTAANILFSAGYDYKVMIWNLDTKESVITSPMSTISCHQDVILSMSFNTNGSLLATTCKDRKIRVIDPRAGTVLQEASYKGHRASKVLFLGNLKKLMSTGTSRWNNRQVALWDQDNLSVPLMEEDLDGSSGVLFPFYDADTSMLYVVGKGDGNIRYYEVSADKPHLSYLTEYRSYNPQKGIGVMPKRGLDVSSCEIFRFYKLITTKSLIEPISMIVPRRSESYQEDIYPPTAGAQPSLTAQEWLSGMNRDPILVSLRPGSELLRPHPLPAERPIFNSMAPASPRLLNQTEKLAAEDGWRSSSLLEEKMPRWAAEHRLEEKKTWLTNGFDVFECPPPKTENELLQMFYRQQEEIRRLRELLTQREVQAKQLELEIKNLRMGSEQL

SEQ ID NO: 20017 - protein, 525 aa, Homo sapiens; identical to SEQ ID NO: 20016
  Payload ID: 3985
  Gene Symbol: CORO2A
  Gene Name: coronin, actin binding protein, 2A
  Uniprot ID: Q92828
  ENSP ID: ENSP00000364218

SEQ ID NO: 20018 - protein, 475 aa, Homo sapiens
  Payload ID: 3986
  Gene Symbol: CORO2B
  Gene Name: coronin, actin binding protein, 2B
  Uniprot ID: Q9UQ03
  ENSP ID: ENSP00000261861
MSWRPQYRSSKFRNVYGKVANREHCFDGIPITKNVHDNHFCAVNTRFLAIVTESAGGGSFLVIPLEQTGRIEPNYPKVCGHQGNVLDIKWNPFIDNIIASCSEDTSVRIWEIPEGGLKRNMTEALLELHGHSRRVGLVEWHPTTNNILFSAGYDYKVLIWNLDVGEPVKMIDCHTDVILCMSFNTDGSLLTTTCKDKKLRVIEPRSGRVLQEANCKNHRVNRVVFLGNMKRLLTTGVSRWNTRQIALWDQEDLSMPLIEEEIDGLSGLLFPFYDADTHMLYLAGKGDGNIRYYEISTEKPYLSYLMEFRSPAPQKGLGVMPKHGLDVSACEVFRFYKLVTLKGLIEPISMIVPRRSDSYQEDIYPMTPGTEPALTPDEWLGGINRDPVLMSLKEGYKKSSKMVFKAPIKEKKSVVVNGIDLLENVPPRTENELLRMFFRQQDEIRRLKEELAQKDIRIRQLQLELKNLRNSPKNC

SEQ ID NO: 20019 - protein, 475 aa, Homo sapiens; identical to SEQ ID NO: 20018
  Payload ID: 3986
  Gene Symbol: CORO2B
  Gene Name: coronin, actin binding protein, 2B
  Uniprot ID: Q9UQ03
  ENSP ID: ENSP00000443819

SEQ ID NO: 20020 - protein, 475 aa, Homo sapiens; identical to SEQ ID NO: 20018
  Payload ID: 3986
  Gene Symbol: CORO2B
  Gene Name: coronin, actin binding protein, 2B
  Uniprot ID: Q9UQ03
  ENSP ID: ENSP00000446250

SEQ ID NO: 20021 - protein, 480 aa, Homo sapiens
  Payload ID: 3986
  Gene Symbol: CORO2B
  Gene Name: coronin, actin binding protein, 2B
  Uniprot ID: Q9UQ03
  ENSP ID: ENSP00000454783
MTVTKMSWRPQYRSSKFRNVYGKVANREHCFDGIPITKNVHDNHFCAVNTRFLAIVTESAGGGSFLVIPLEQTGRIEPNYPKVCGHQGNVLDIKWNPFIDNIIASCSEDTSVRIWEIPEGGLKRNMTEALLELHGHSRRVGLVEWHPTTNNILFSAGYDYKVLIWNLDVGEPVKMIDCHTDVILCMSFNTDGSLLTTTCKDKKLRVIEPRSGRVLQEANCKNHRVNRVVFLGNMKRLLTTGVSRWNTRQIALWDQEDLSMPLIEEEIDGLSGLLFPFYDADTHMLYLAGKGDGNIRYYEISTEKPYLSYLMEFRSPAPQKGLGVMPKHGLDVSACEVFRFYKLVTLKGLIEPISMIVPRRSDSYQEDIYPMTPGTEPALTPDEWLGGINRDPVLMSLKEGYKKSSKMVFKAPIKEKKSVVVNGIDLLENVPPRTENELLRMFFRQQDEIRRLKEELAQKDIRIRQLQLELKNLRNSPKNC

SEQ ID NO: 20022 - protein, 550 aa, Homo sapiens
  Payload ID: 3987
  Gene Symbol: CTTN
  Gene Name: cortactin
  Uniprot ID: Q14247
  ENSP ID: ENSP00000301843
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 20023 - protein, 513 aa, Homo sapiens
  Payload ID: 3987
  Gene Symbol: CTTN
  Gene Name: cortactin
  Uniprot ID: Q14247
  ENSP ID: ENSP00000317189
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 20024 - protein, 634 aa, Homo sapiens
  Payload ID: 3987
  Gene Symbol: CTTN
  Gene Name: cortactin
  Uniprot ID: Q14247
  ENSP ID: ENSP00000365745
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRFRELAFSCVRVALVPIKCSRDLPGQARGLRSALWRVGRKDCPRRGASSRVSLLGRRGLGLMEVNPELSHPEHRSCHVRWEICLCHTVTARRIRKLISFLRSREAGPVPSCSQVGGVSFQKVTWKCLGTWVPECP

SEQ ID NO: 20025 - protein, 265 aa, Homo sapiens
  Payload ID: 3987
  Gene Symbol: CTTN
  Gene Name: cortactin
  ENSP ID: ENSP00000431421
TSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRFRELAFSCVRVALVPIKCSRDLPGQARGLRKLISFLRSREAGPVPSCSQVGGVSFQKVTWKCLGTWVPECP

SEQ ID NO: 20026 - protein, 128 aa, Homo sapiens
  Payload ID: 3987
  Gene Symbol: CTTN
  Gene Name: cortactin
  ENSP ID: ENSP00000436613
RKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAALSWLSFRGQHLR

SEQ ID NO: 20027 - protein, 1663 aa, Homo sapiens
  Payload ID: 3988
  Gene Symbol: CTTNBP2
  Gene Name: cortactin binding protein 2
  Uniprot ID: Q8WZ74
  ENSP ID: ENSP00000160373
MATDGASCEPDLSRAPEDAAGAAAEAAKKEFDVDTLSKSELRMLLSVMEGELEARDLVIEALRARRKEVFIQERYGRFNLNDPFLALQRDYEAGAGDKEKKPVCTNPLSILEAVMAHCKKMQERMSAQLAAAESRQKKLEMEKLQLQALEQEHKKLAARLEEERGKNKQVVLMLVKECKQLSGKVIEEAQKLEDVMAKLEEEKKKTNELEEELSAEKRRSTEMEAQMEKQLSEFDTEREQLRAKLNREEAHTTDLKEEIDKMRKMIEQLKRGSDSKPSLSLPRKTKDRRLVSISVGTEGTVTRSVACQTDLVTENADHMKKLPLTMPVKPSTGSPLVSANAKGSVCTSATMARPGIDRQASYGDLIGASVPAFPPPSANKIEENGPSTGSTPDPTSSTPPLPSNAAPPTAQTPGIAPQNSQAPPMHSLHSPCANTSLHPGLNPRIQAARFRFQGNANDPDQNGNTTQSPPSRDVSPTSRDNLVAKQLARNTVTQALSRFTSPQAGAPSRPGVPPTGDVGTHPPVGRTSLKTHGVARVDRGNPPPIPPKKPGLSQTPSPPHPQLKVIIDSSRASNTGAKVDNKTVASTPSSLPQGNRVINEENLPKSSSPQLPPKPSIDLTVAPAGCAVSALATSQVGAWPAATPGLNQPACSDSSLVIPTTIAFCSSINPVSASSCRPGASDSLLVTASGWSPSLTPLLMSGGPAPLAGRPTLLQQAAAQGNVTLLSMLLNEEGLDINYSCEDGHSALYSAAKNGHTDCVRLLLSAEAQVNAADKNGFTPLCAAAAQGHFECVELLISYDANINHAADGGQTPLYLACKNGNKECIKLLLEAGTNRSVKTTDGWTPVHAAVDTGNVDSLKLLMYHRIPAHGNSFNEEESESSVFDLDGGEESPEGISKPVVPADLINHANREGWTAAHIAASKGFKNCLEILCRHGGLEPERRDKCNRTVHDVATDDCKHLLENLNALKIPLRISVGEIEPSNYGSDDLECENTICALNIRKQTSWDDFSKAVSQALTNHFQAISSDGWWSLEDVTCNNTTDSNIGLSARSIRSITLGNVPWSVGQSFAQSPWDFMRKNKAEHITVLLSGPQEGCLSSVTYASMIPLQMMQNYLRLVEQYHNVIFHGPEGSLQDYIVHQLALCLKHRQMAAGFSCEIVRAEVDAGFSKEQLLDLFISSACLIPVKQSPSKKKIIIILENLEKSSLSELLRDFLAPLENRSTESPCTFQKGNGLSECYYFHENCFLMGTIAKACLQGSDLLVQQHFRWVQLRWDGEPMQGLLQRFLRRKVVNKFKGQAPSPCDPVCKIVDWALSVWRQLNSCLARLGTPEALLGPKYFLSCPVVPGHAQVTVKWMSKLWNGVIAPRVQEAILSRASVKRQPGFGQTTAKRHPSQGQQAVVKAALSILLNKAVLHGCPLPRAELDQHTADFKGGSFPLSIVSSYNTCNKKKGESGAWRKVNTSPRRKSGRFSLPTWNKPDLSTEGMKNKTISQLNCNRNASLSKQKSLENDLSLTLNLDQRLSLGSDDEADLVKELQSMCSSKSESDISKIADSRDDLRMFDSSGNNPVLSATINNLRMPVSQKEVSPLSSHQTTECSNSKSKTELGVSRVKSFLPVPRSKVTQCSQNTKRSSSSSNTRQIEINNNSKEVNWNLHKNEHLEKPNK

SEQ ID NO: 20028 - protein, 47 aa, Homo sapiens
  Payload ID: 3988
  Gene Symbol: CTTNBP2
  Gene Name: cortactin binding protein 2
  ENSP ID: ENSP00000389491
  MOD_RES (1)..(1): Any amino acid
XSVWRQLNSCLARLGTPEALLGPKYFLSCPVVPGHAQVTVKARPAYS

SEQ ID NO: 20029 - protein, 1151 aa, Homo sapiens
  Payload ID: 3988
  Gene Symbol: CTTNBP2
  Gene Name: cortactin binding protein 2
  ENSP ID: ENSP00000389576
  MOD_RES (1)..(1): Any amino acid
XDVSPTSRDNLVAKQLARNTVTQALSRFTSPQAGAPSRPGVPPTGDVGTHPPVGRTSLKTHGVARVDRGNPPPIPPKKPGLSQTPSPPHPQLKVIIDSSRASNTGAKVDNKTVASTPSSLPQGNRVINEENLPKSSSPQLPPKPSIDLTVAPAGCAVSALATSQKIQKVKCTREEPSCWSPSLTPLLMSGGPAPLAGRPTLLQQAAAQGNVTLLSMLLNEEGLDINYSCEDGHSALYSAAKNGHTDCVRLLLSAEAQVNAADKNGFTPLCAAAAQGHFECVELLISYDANINHAADGGQTPLYLACKNGNKECIKLLLEAGTNRSVKTTDGWTPVHAAVDTGNVDSLKLLMYHRIPAHGNSFNEEESESSVFDLDGGEESPEGISKPVVPADLINHANREGWTAAHIAASKGFKNCLEILCRHGGLEPERRDKCNRTVHDVATDDCKHLLENLNALKIPLRISVGEIEPSNYGSDDLECENTICALNIRKQTSWDDFSKAVSQALTNHFQAISSDGWWSLEDVTCNNTTDSNIGLSARSIRSITLGNVPWSVGQSFAQSPWDFMRKNKAEHITVLLSGPQEGCLSSVTYASMIPLQMMQNYLRLVEQYHNVIFHGPEGSLQDYIVHQLALCLKHRQMAAGFSCEIVRAEVDAGFSKEQLLDLFISSACLIPVKQSPSKKKIIIILENLEKSSLSELLRDFLAPLENRSTESPCTFQKGNGLSECYYFHENCFLMGTIAKACLQGSDLLVQQHFRWVQLRWDGEPMQGLLQRFLRRKVVNKFKGQAPSPCDPVCKIVDWALSVWRQLNSCLARLGTPEALLGPKYFLSCPVVPGHAQVTVKWMSKLWNGVIAPRVQEAILSRASVKRQPGFGQTTAKRHPSQGQQAVVKAALSILLNKAVLHGCPLPRAELDQHTADFKGGSFPLSIVSSYNTCNKKKGESGAWRKVNTSPRRKSGRFSLPTWNKPDLSTEGMKNKTISQLNCNRNASLSKQKSLENDLSLTLNLDQRLSLGSDDEADLVKELQSMCSSKSESDISKIADSRDDLRMFDSSGNNPVLSATINNLRMPVSQKEVSPLSSHQTTECSNSKSKTELGVSRVKSFLPVPRSKVTQCSQNTKRSSSSSNTRQIEINNNSKEVNWNLHKNEHLEKPNK

SEQ ID NO: 20030 - protein, 95 aa, Homo sapiens
  Payload ID: 3988
  Gene Symbol: CTTNBP2
  Gene Name: cortactin binding protein 2
  ENSP ID: ENSP00000393373
MLLSVMEGELEARDLVIEALRARRKEVFIQERYGRFNLNDPFLALQRDYEAGAGDKEKKPVCTNPLSILEAVMAHCKKMQERMSAQLAAAESRQK

SEQ ID NO: 20031 - protein, 193 aa, Homo sapiens
  Payload ID: 3988
  Gene Symbol: CTTNBP2
  Gene Name: cortactin binding protein 2
  ENSP ID: ENSP00000395925
  MOD_RES (1)..(1): Any amino acid
XDLECENTICALNIRKQTSWDDFSKAVSQALTNHFQAISSDGWWSLEDVTCNNTTDSNIGLSARSIRSITLGNVPWSVGQSFAQSPWDFMRKNKAEHITVLLSGPQEGCLSSVTYASMIPLQMMQNYLRLHRQMAAGFSCEIVRAEVDAGFSKEQLLDLFISSACLIPVKQSPSKKKIIIILENLEKSSLSEL

SEQ ID NO: 20032 - protein, 161 aa, Homo sapiens
  Payload ID: 3988
  Gene Symbol: CTTNBP2
  Gene Name: cortactin binding protein 2
  ENSP ID: ENSP00000396014
MLLSVMEGELEARDLVIEALRARRKEVFIQERYGRFNLNDPFLALQRDYEAGAGDKEKKPVCTNPLSILEAVMAHCKKMQERMSAQLAAAESRQKKLEMEKLQLQALEQEHKKLAARLEEERGKNKQVVLMLVKECKQLSGKVIEEAQKLEDVMAKLEEEK

SEQ ID NO: 20033 - protein, 640 aa, Homo sapiens
  Payload ID: 3988
  Gene Symbol: CTTNBP2
  Gene Name: cortactin binding protein 2
  ENSP ID: ENSP00000397678
MATDGASCEPDLSRAPEDAAGAAAEAAKKEFDVDTLSKSELRMLLSVMEGELEARDLVIEALRARRKEVFIQERYGRFNLNDPFLALQRDYEAGAGDKEKKPVCTNPLSILEAVMAHCKKMQERMSAQLAAAESRQKKLEMEKLQLQALEQEHKKLAARLEEERGKNKQVVLMLVKECKQLSGKVIEEAQKLEDVMAKLEEEKKKTNELEEELSAEKRRSTEMEAQMEKQLSEFDTEREQLRAKLNREEAHTTDLKEEIDKMRKMIEQLKRGSDSKPSLSLPRKTKDRRLVSISVGTEGTVTRSVACQTDLVTENADHMKKLPLTMPVKPSTGSPLVSANAKGSVCTSATMARPGIDRQASYGDLIGASVPAFPPPSANKIEENGPSTGSTPDPTSSTPPLPSNAAPPTAQTPGIAPQNSQAPPMHSLHSPCANTSLHPGLNPRIQAARFRFQGNANDPDQNGNTTQSPPSRDVSPTSRDNLVAKQLARNTVTQALSRFTSPQAGAPSRPGVPPTGDVGTHPPVGRTSLKTHGVARVDRGNPPPIPPKKPGLSQTPSPPHPQLKVIIDSSRASNTGAKVDNKTVASTPSSLPQGNRVINEENLPKSSSPQLPPKPSIDLTVAPAGCAVSALATSQAGHPP

SEQ ID NO: 20034 - protein, 136 aa, Homo sapiens
  Payload ID: 3988
  Gene Symbol: CTTNBP2
  Gene Name: cortactin binding protein 2
  ENSP ID: ENSP00000405831
MLLSVMEGELEARDLVIEALRARRKEVFIQERYGRFNLNDPFLALQRDYEAGAGDKEKKPVCTNPLSILEAVMAHCKKMQERMSAQLAAAESRQKKLEMEKLQLQALEQEHKKLAARLEEERGKNKQVVLMLVKEC

SEQ ID NO: 20035 - protein, 120 aa, Homo sapiens
  Payload ID: 3988
  Gene Symbol: CTTNBP2
  Gene Name: cortactin binding protein 2
  ENSP ID: ENSP00000406142
  MOD_RES (1)..(1): Any amino acid
XWDDFSKAVSQALTNHFQAISSDGWWSLEDVTCNNTTDSNIGLSARSIRSITLGNVPWSVGQSFAQSPWDFMRKNKAEHITVLLSGPQEGCLSSVTYASMIPLQMMQNYLRLMGKLNRER

SEQ ID NO: 20036 - protein, 82 aa, Homo sapiens
  Payload ID: 3989
  Gene Symbol: CTXN1
  Gene Name: cortexin 1
  Uniprot ID: P60606
  ENSP ID: ENSP00000313226
MSATWTLSPEPLPPSTGPPVGAGLDAEQRTVFAFVLCLLVVLVLLMVRCVRILLDPYSRMPASSWTDHKEALERGQFDYALV

SEQ ID NO: 20037 - protein, 81 aa, Homo sapiens
  Payload ID: 3990
  Gene Symbol: CTXN2
  Gene Name: cortexin 2
  Uniprot ID: P0C2S0
  ENSP ID: ENSP00000406145
MSSTYCGNSSAKMSVNEVSAFSLTLEQKTGFAFVGILCIFLGLLIIRCFKILLDPYSSMPSSTWEDEVEEFDKGTFEYALA

SEQ ID NO: 20038 - protein, 81 aa, Homo sapiens
  Payload ID: 3991
  Gene Symbol: CTXN3
  Gene Name: cortexin 3
  Uniprot ID: Q4LDR2
  ENSP ID: ENSP00000368758
MDGGQPIPSSLVPLGNESADSSMSLEQKMTFVFVILLFIFLGILIVRCFRILLDPYRSMPTSTWADGLEGLEKGQFDHALA

SEQ ID NO: 20039 - protein, 81 aa, Homo sapiens; identical to SEQ ID NO: 20038
  Payload ID: 3991
  Gene Symbol: CTXN3
  Gene Name: cortexin 3
  Uniprot ID: Q4LDR2
  ENSP ID: ENSP00000378732

SEQ ID NO: 20040 - protein, 81 aa, Homo sapiens; identical to SEQ ID NO: 20038
  Payload ID: 3991
  Gene Symbol: CTXN3
  Gene Name: cortexin 3
  Uniprot ID: Q4LDR2
  ENSP ID: ENSP00000482081

SEQ ID NO: 20041 - protein, 196 aa, Homo sapiens
  Payload ID: 3992
  Gene Symbol: CRH
  Gene Name: corticotropin releasing hormone
  Uniprot ID: P06850
  ENSP ID: ENSP00000276571
MRLPLLVSAGVLLVALLPCPPCRALLSRGPVPGARQAPQHPQPLDFFQPPPQSEQPQQPQARPVLLRMGEEYFLRLGNLNKSPAAPLSPASSLLAGGSGSRPSPEQATANFFRVLLQQLLLPRRSLDSPAALAERGARNALGGHQEAPERERRSEEPPISLDLTFHLLREVLEMARAEQLAQQAHSNRKLMEIIGK

SEQ ID NO: 20042 - protein, 322 aa, Homo sapiens
  Payload ID: 3993
  Gene Symbol: CRHBP
  Gene Name: corticotropin releasing hormone binding protein
  Uniprot ID: P24387
  ENSP ID: ENSP00000274368
MSPNFKLQCHFILIFLTALRGESRYLELREAADYDPFLLFSANLKRELAGEQPYRRALRCLDMLSLQGQFTFTADRPQLHCAAFFISEPEEFITIHYDQVSIDCQGGDFLKVFDGWILKGEKFPSSQDHPLPSAERYIDFCESGLSRRSIRSSQNVAMIFFRVHEPGNGFTLTIKTDPNLFPCNVISQTPNGKFTLVVPHQHRNCSFSIIYPVVIKISDLTLGHVNGLQLKKSSAGCEGIGDFVELLGGTGLDPSKMTPLADLCYPFHGPAQMKVGCDNTVVRMVSSGKHVNRVTFEYRQLEPYELENPNGNSIGEFCLSGL

SEQ ID NO: 20043 - protein, 238 aa, Homo sapiens
  Payload ID: 3993
  Gene Symbol: CRHBP
  Gene Name: corticotropin releasing hormone binding protein
  ENSP ID: ENSP00000426097
MSPNFKLQCHFILIFLTALRGESRYLELREAADYDPFLLFSANLKRELAGEQPYRRALRCLDMLSLQGQFTFTADRPQLHCAAFFISEPEEFITIHYDQVSIDCQGGDFLKVFDGWILKGEKFPSSQDHPLPSAERYIDFCESGLSRRSIRSSQNVAMIFFRVHEPGNGFTLTIKTDPNLFPCNVISQTPNGKFTLVVPHQHRNCSFSIIYPVVIKISDLTLGHVNGLQLKVSCLLVS

SEQ ID NO: 20044 - protein, 145 aa, Homo sapiens
  Payload ID: 3994
  Gene Symbol: CRHR1
  Gene Name: corticotropin releasing hormone receptor 1
  ENSP ID: ENSP00000239167
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLS

SEQ ID NO: 20045 - protein, 430 aa, Homo sapiens
  Payload ID: 3994
  Gene Symbol: CRHR1
  Gene Name: corticotropin releasing hormone receptor 1
  ENSP ID: ENSP00000293493
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRPGCTHWGDQADGALEVGAPWSGAPFQVRRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQVRSAIRKRWHRWQDKHSIRARVARAMSIPTSPTRVSFHSIKQSTAV

SEQ ID NO: 20046 - protein, 415 aa, Homo sapiens
  Payload ID: 3994
  Gene Symbol: CRHR1
  Gene Name: corticotropin releasing hormone receptor 1
  Uniprot ID: P34998
  ENSP ID: ENSP00000326060
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 20047 - protein, 314 aa, Homo sapiens
  Payload ID: 3994
  Gene Symbol: CRHR1
  Gene Name: corticotropin releasing hormone receptor 1
  ENSP ID: ENSP00000340522
MVSATIPQKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 20048 - protein, 375 aa, Homo sapiens
  Payload ID: 3994
  Gene Symbol: CRHR1
  Gene Name: corticotropin releasing hormone receptor 1
  Uniprot ID: P34998
  ENSP ID: ENSP00000344068
MGGHPQLRLVKALLLLGLNPVSASLQDQHCESLSLASNISDNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 20049 - protein, 444 aa, Homo sapiens
  Payload ID: 3994
  Gene Symbol: CRHR1
  Gene Name: corticotropin releasing hormone receptor 1
  Uniprot ID: P34998
  ENSP ID: ENSP00000381333
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRPGCTHWGDQADGALEVGAPWSGAPFQVRRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 20050 - protein, 52 aa, Homo sapiens
  Payload ID: 3994
  Gene Symbol: CRHR1
  Gene Name: corticotropin releasing hormone receptor 1
  ENSP ID: ENSP00000439934
  MOD_RES (1)..(1): Any amino acid
XCWFGKRPGVYTDYIYQGPMILVLLEGCESHSGAAAPPGHHLHAVLRQSRGG

SEQ ID NO: 20051 - protein, 401 aa, Homo sapiens
  Payload ID: 3994
  Gene Symbol: CRHR1
  Gene Name: corticotropin releasing hormone receptor 1
  Uniprot ID: P34998
  ENSP ID: ENSP00000462016
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQVRSAIRKRWHRWQDKHSIRARVARAMSIPTSPTRVSFHSIKQSTAV

SEQ ID NO: 20052 - protein, 152 aa, Homo sapiens
  Payload ID: 3994
  Gene Symbol: CRHR1
  Gene Name: corticotropin releasing hormone receptor 1
  ENSP ID: ENSP00000462553
YGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVVCPSPSLWPGPLGSCTTTMRSAGLAKGLGCTPTTSTRAP

SEQ ID NO: 20053 - protein, 75 aa, Homo sapiens
  Payload ID: 3994
  Gene Symbol: CRHR1
  Gene Name: corticotropin releasing hormone receptor 1
  ENSP ID: ENSP00000463177
  MOD_RES (1)..(1): Any amino acid
XCWFGKRPGVYTDYIYQGPMILVLLINFIFLFNIVRILMTKLRASTTSETIQYRASLCLCSTVSSIVRSVLPSGR

SEQ ID NO: 20054 - protein, 93 aa, Homo sapiens
  Payload ID: 3994
  Gene Symbol: CRHR1
  Gene Name: corticotropin releasing hormone receptor 1
  ENSP ID: ENSP00000463852
  MOD_RES (1)..(1): Any amino acid
XSLASNISGLQCNASVDLIGTCWPRSPAGQLVVRPCPAFFYGVRYNTTNNGYRECLANGSWAARVNYSECQEILNEEEPGPQAQPGRAHRGGT

SEQ ID NO: 20055 - protein, 415 aa, Homo sapiens; identical to SEQ ID NO: 20046
  Payload ID: 3994
  Gene Symbol: CRHR1
  Gene Name: corticotropin releasing hormone receptor 1
  Uniprot ID: P34998
  ENSP ID: ENSP00000477786

SEQ ID NO: 20056 - protein, 375 aa, Homo sapiens; identical to SEQ ID NO: 20048
  Payload ID: 3994
  Gene Symbol: CRHR1
  Gene Name: corticotropin releasing hormone receptor 1
  Uniprot ID: P34998
  ENSP ID: ENSP00000478177

SEQ ID NO: 20057 - protein, 154 aa, Homo sapiens
  Payload ID: 3994
  Gene Symbol: CRHR1
  Gene Name: corticotropin releasing hormone receptor 1
  ENSP ID: ENSP00000478252
MGGHPQLRLVKALLLLGLNPVSASLQDQHCESLSLASNISEKKQGALPCRSHHQLPGPLYLPGGPPGGLCPLSAAQEHPVPAKHHPLEPHLRLHPAQRHLVRGPANHEPRGPPEQRGLVQVGDSRLQLLPCDQLLLDVRRGLLPAHSHRAHLLH

SEQ ID NO: 20058 - protein, 186 aa, Homo sapiens
  Payload ID: 3994
  Gene Symbol: CRHR1
  Gene Name: corticotropin releasing hormone receptor 1
  ENSP ID: ENSP00000478408
MGGHPQLRLVKALLLLGLNPVSASLQDQHCESLSLASNISEKKQGALPCRSHHQLPGPLYLPGGPPGGLCPLSAAQEHPVPAKHHPLEPHLRLHPAQRHLVRGPANHEPRGPPEQRGLVQVGDSRLQLLPCDQLLLDVRRGLLPAHSHRAHLLHRPAAQMDVHLHWLGCALPHHCGLGHWEAVLRQ

SEQ ID NO: 20059 - protein, 430 aa, Homo sapiens; identical to SEQ ID NO: 20045
  Payload ID: 3994
  Gene Symbol: CRHR1
  Gene Name: corticotropin releasing hormone receptor 1
  ENSP ID: ENSP00000479052

SEQ ID NO: 20060 - protein, 430 aa, Homo sapiens; identical to SEQ ID NO: 20045
  Payload ID: 3994
  Gene Symbol: CRHR1
  Gene Name: corticotropin releasing hormone receptor 1
  ENSP ID: ENSP00000480241

SEQ ID NO: 20061 - protein, 444 aa, Homo sapiens; identical to SEQ ID NO: 20049
  Payload ID: 3994
  Gene Symbol: CRHR1
  Gene Name: corticotropin releasing hormone receptor 1
  Uniprot ID: P34998
  ENSP ID: ENSP00000480396

SEQ ID NO: 20062 - protein, 375 aa, Homo sapiens; identical to SEQ ID NO: 20048
  Payload ID: 3994
  Gene Symbol: CRHR1
  Gene Name: corticotropin releasing hormone receptor 1
  Uniprot ID: P34998
  ENSP ID: ENSP00000480752

SEQ ID NO: 20063 - protein, 314 aa, Homo sapiens; identical to SEQ ID NO: 20047
  Payload ID: 3994
  Gene Symbol: CRHR1
  Gene Name: corticotropin releasing hormone receptor 1
  ENSP ID: ENSP00000481116

SEQ ID NO: 20064 - protein, 415 aa, Homo sapiens; identical to SEQ ID NO: 20046
  Payload ID: 3994
  Gene Symbol: CRHR1
  Gene Name: corticotropin releasing hormone receptor 1
  Uniprot ID: P34998
  ENSP ID: ENSP00000483802

SEQ ID NO: 20065 - protein, 314 aa, Homo sapiens; identical to SEQ ID NO: 20047
  Payload ID: 3994
  Gene Symbol: CRHR1
  Gene Name: corticotropin releasing hormone receptor 1
  ENSP ID: ENSP00000484097

SEQ ID NO: 20066 - protein, 444 aa, Homo sapiens; identical to SEQ ID NO: 20049
  Payload ID: 3994
  Gene Symbol: CRHR1
  Gene Name: corticotropin releasing hormone receptor 1
  Uniprot ID: P34998
  ENSP ID: ENSP00000484387

SEQ ID NO: 20067 - protein, 154 aa, Homo sapiens; identical to SEQ ID NO: 20057
  Payload ID: 3994
  Gene Symbol: CRHR1
  Gene Name: corticotropin releasing hormone receptor 1
  ENSP ID: ENSP00000484545

SEQ ID NO: 20068 - protein, 152 aa, Homo sapiens; identical to SEQ ID NO: 20052
  Payload ID: 3994
  Gene Symbol: CRHR1
  Gene Name: corticotropin releasing hormone receptor 1
  ENSP ID: ENSP00000487873

SEQ ID NO: 20069 - protein, 52 aa, Homo sapiens; identical to SEQ ID NO: 20050
  Payload ID: 3994
  Gene Symbol: CRHR1
  Gene Name: corticotropin releasing hormone receptor 1
  ENSP ID: ENSP00000488141
  MOD_RES (1)..(1): Any amino acid

SEQ ID NO: 20070 - protein, 401 aa, Homo sapiens; identical to SEQ ID NO: 20051
  Payload ID: 3994
  Gene Symbol: CRHR1
  Gene Name: corticotropin releasing hormone receptor 1
  Uniprot ID: P34998
  ENSP ID: ENSP00000488342

SEQ ID NO: 20071 - protein, 93 aa, Homo sapiens; identical to SEQ ID NO: 20054
  Payload ID: 3994
  Gene Symbol: CRHR1
  Gene Name: corticotropin releasing hormone receptor 1
  ENSP ID: ENSP00000488353
  MOD_RES (1)..(1): Any amino acid

SEQ ID NO: 20072 - protein, 145 aa, Homo sapiens; identical to SEQ ID NO: 20044
  Payload ID: 3994
  Gene Symbol: CRHR1
  Gene Name: corticotropin releasing hormone receptor 1
  ENSP ID: ENSP00000488779

SEQ ID NO: 20073 - protein, 75 aa, Homo sapiens; identical to SEQ ID NO: 20053
  Payload ID: 3994
  Gene Symbol: CRHR1
  Gene Name: corticotropin releasing hormone receptor 1
  ENSP ID: ENSP00000488796
  MOD_RES (1)..(1): Any amino acid

SEQ ID NO: 20074 - protein, 240 aa, Homo sapiens
  Payload ID: 3995
  Gene Symbol:
  Gene Name: corticotropin releasing hormone receptor 1 [Source:EntrezGene
  Acc:1394]
  ENSP ID: ENSP00000488912
MSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 20075 - protein, 438 aa, Homo sapiens
  Payload ID: 3996
  Gene Symbol: CRHR2
  Gene Name: corticotropin releasing hormone receptor 2
  Uniprot ID: Q13324
  ENSP ID: ENSP00000340943
MRGPSGPPGLLYVPHLLLCLLCLLPPPLQYAAGQSQMPKDQPLWALLEQYCHTIMTLTNLSGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 20076 - protein, 397 aa, Homo sapiens
  Payload ID: 3996
  Gene Symbol: CRHR2
  Gene Name: corticotropin releasing hormone receptor 2
  Uniprot ID: Q13324
  ENSP ID: ENSP00000344304
MGREPWPEDRDLGFPQLFCQGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 20077 - protein, 99 aa, Homo sapiens
  Payload ID: 3996
  Gene Symbol: CRHR2
  Gene Name: corticotropin releasing hormone receptor 2
  ENSP ID: ENSP00000401241
MRGPSGPPGLLYVPHLLLCLLCLLPPPLQYAAGQSQMPKDQPLWALLEQYCHTIMTLTNLSVTPGAHSHSLSARGCGTRWTRHCSTACWRPTAAWRWLK

SEQ ID NO: 20078 - protein, 64 aa, Homo sapiens
  Payload ID: 3996
  Gene Symbol: CRHR2
  Gene Name: corticotropin releasing hormone receptor 2
  ENSP ID: ENSP00000401930
MRGPSGPPGLLYVPHLLLCLLCLLPPPLQYAAGQSQMPKDQPLWALLEQYCHTIMTLTNLSGWS

SEQ ID NO: 20079 - protein, 64 aa, Homo sapiens; identical to SEQ ID NO: 20078
  Payload ID: 3996
  Gene Symbol: CRHR2
  Gene Name: corticotropin releasing hormone receptor 2
  ENSP ID: ENSP00000416620

SEQ ID NO: 20080 - protein, 411 aa, Homo sapiens
  Payload ID: 3996
  Gene Symbol: CRHR2
  Gene Name: corticotropin releasing hormone receptor 2
  Uniprot ID: Q13324
  ENSP ID: ENSP00000418722
MDAALLHSLLEANCSLALAEELLLDGWGPPLDPEGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 20081 - protein, 387 aa, Homo sapiens
  Payload ID: 3996
  Gene Symbol: CRHR2
  Gene Name: corticotropin releasing hormone receptor 2
  Uniprot ID: Q13324
  ENSP ID: ENSP00000426498
MDAALLHSLLEANCSLALAEELLLDGWGPPLDPEGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGESWVSKEAQAAGPHGREKPEQRW

SEQ ID NO: 20082 - protein, 105 aa, Homo sapiens
  Payload ID: 3997
  Gene Symbol: CORT
  Gene Name: cortistatin
  Uniprot ID: O00230
  ENSP ID: ENSP00000366248
MPLSPGLLLLLLSGATATAALPLEGGPTGRDSEHMQEAAGIRKSSLLTFLAWWFEWTSQASAGPLIGEEAREVARRQEGAPPQQSARRDRMPCRNFFWKTFSSCK

SEQ ID NO: 20083 - protein, 443 aa, Homo sapiens
  Payload ID: 3998
  Gene Symbol: COX10
  Gene Name: COX10 heme A:farnesyltransferase cytochrome c oxidase assembly factor
  Uniprot ID: Q12887
  ENSP ID: ENSP00000261643
MAASPHTLSSRLLTGCVGGSVWYLERRTIQDSPHKFLHLLRNVNKQWITFQHFSFLKRMYVTQLNRSHNQQVRPKPEPVASPFLEKTSSGQAKAEIYEMRPLSPPSLSLSRKPNEKELIELEPDSVIEDSIDVGKETKEEKRWKEMKLQVYDLPGILARLSKIKLTALVVSTTAAGFALAPGPFDWPCFLLTSVGTGLASCAANSINQFFEVPFDSNMNRTKNRPLVRGQISPLLAVSFATCCAVPGVAILTLGVNPLTGALGLFNIFLYTCCYTPLKRISIANTWVGAVVGAIPPVMGWTAATGSLDAGAFLLGGILYSWQFPHFNALSWGLREDYSRGGYCMMSVTHPGLCRRVALRHCLALLVLSAAAPVLDITTWTFPIMALPINAYISYLGFRFYVDADRRSSRRLFFCSLWHLPLLLLLMLTCKRPSGGGDAGPPPS

SEQ ID NO: 20084 - protein, 171 aa, Homo sapiens
  Payload ID: 3998
  Gene Symbol: COX10
  Gene Name: COX10 heme A:farnesyltransferase cytochrome c oxidase assembly factor
  ENSP ID: ENSP00000397750
MAASPHTLSSRLLTGCVGGSVWYLERRTIQDSPHKFLHLLRNVNKQWITFQHFSFLKRMYVTQLNRSHNQQVRPKPEPVASPFLEKTSSGQAKAEIYEMRPLSPPSLSLSRKPNEKELIELEPDSVIEDSIDVGKETKEEKRWKEMKLQVYDLPGILARLSKIKLTGTLFF

SEQ ID NO: 20085 - protein, 62 aa, Homo sapiens
  Payload ID: 3998
  Gene Symbol: COX10
  Gene Name: COX10 heme A:farnesyltransferase cytochrome c oxidase assembly factor
  ENSP ID: ENSP00000462190
MAASPHTLSSRLLTGCVGGSVWYLERRTIQDSPHKFLHLLRNVNKQWITFQHFSFLKRMLWL

SEQ ID NO: 20086 - protein, 168 aa, Homo sapiens
  Payload ID: 3998
  Gene Symbol: COX10
  Gene Name: COX10 heme A:farnesyltransferase cytochrome c oxidase assembly factor
  ENSP ID: ENSP00000462512
MAASPHTLSSRLLTGCVGGSVWYLERRTIQDSPHKFLHLLRNVNKQWITFQHFSFLKRMYVTQLNRSHNQQVRPKPEPVASPFLEKTSSGQAKAEIYEMRPLSPPSLSLSRKPNEKELIELEPDSVIEDSIDVGKETKEEKRWKEMKLQVYDLPGILARLSKIKLTVF

SEQ ID NO: 20087 - protein, 276 aa, Homo sapiens
  Payload ID: 3999
  Gene Symbol: COX11
  Gene Name: COX11 cytochrome c oxidase copper chaperone
  Uniprot ID: Q9Y6N1
  ENSP ID: ENSP00000299335
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQTTGLGGSAVAGHASDKIENMVPVKDRIIKISFNADVHASLQWNFRPQQTEIYVVPGETALAFYRAKNPTDKPVIGISTYNIVPFEAGQYFNKIQCFCFEEQRLNPQEEVDMPVFFYIDPEFAEDPRMIKVDLITLSYTFFEAKEGHKLPVPGYN

SEQ ID NO: 20088 - protein, 231 aa, Homo sapiens
  Payload ID: 3999
  Gene Symbol: COX11
  Gene Name: COX11 cytochrome c oxidase copper chaperone
  Uniprot ID: Q9Y6N1
  ENSP ID: ENSP00000459302
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQTTGLGGSAVAGHASDKIENMVPVKDRIIKISFNADVHASLQWNFRPQQTEIYVVPGETALAFYRAKNPTDKPVIGISTYNIVPFEAGQYFNKIQASKLHRVYVLESWHL

SEQ ID NO: 20089 - protein, 276 aa, Homo sapiens; identical to SEQ ID NO: 20087
  Payload ID: 3999
  Gene Symbol: COX11
  Gene Name: COX11 cytochrome c oxidase copper chaperone
  Uniprot ID: Q9Y6N1
  ENSP ID: ENSP00000459901

SEQ ID NO: 20090 - protein, 230 aa, Homo sapiens
  Payload ID: 3999
  Gene Symbol: COX11
  Gene Name: COX11 cytochrome c oxidase copper chaperone
  ENSP ID: ENSP00000460043
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQTTGLGGSAVAGHASDKIENMVPVKDRIIKISFNADVHASLQWNFRPQQTEIYVVPGETALAFYRAKNPTDKPVIGISTYNIVPFEAGQYFNKIQVHQSVNFTEYDKDT

SEQ ID NO: 20091 - protein, 51 aa, Homo sapiens
  Payload ID: 3999
  Gene Symbol: COX11
  Gene Name: COX11 cytochrome c oxidase copper chaperone
  ENSP ID: ENSP00000461191
  MOD_RES (1)..(1): Any amino acid
XALAFYRAKNPTDKPVIGISTYNIVPFEAGQYFNKIQVLSSRLQSCTESTF

SEQ ID NO: 20092 - protein, 57 aa, Homo sapiens
  Payload ID: 4000
  Gene Symbol: COX14
  Gene Name: COX14 cytochrome c oxidase assembly factor
  Uniprot ID: Q96I36
  ENSP ID: ENSP00000326052
MPTGKQLADIGYKTFSTSMMLLTVYGGYLCSVRVYHYFQWRRAQRQAAEEQKTSGIM

SEQ ID NO: 20093 - protein, 57 aa, Homo sapiens; identical to SEQ ID NO: 20092
  Payload ID: 4000
  Gene Symbol: COX14
  Gene Name: COX14 cytochrome c oxidase assembly factor
  Uniprot ID: Q96I36
  ENSP ID: ENSP00000446524

SEQ ID NO: 20094 - protein, 57 aa, Homo sapiens; identical to SEQ ID NO: 20092
  Payload ID: 4000
  Gene Symbol: COX14
  Gene Name: COX14 cytochrome c oxidase assembly factor
  Uniprot ID: Q96I36
  ENSP ID: ENSP00000447776

SEQ ID NO: 20095 - protein, 57 aa, Homo sapiens; identical to SEQ ID NO: 20092
  Payload ID: 4000
  Gene Symbol: COX14
  Gene Name: COX14 cytochrome c oxidase assembly factor
  Uniprot ID: Q96I36
  ENSP ID: ENSP00000450331

SEQ ID NO: 20096 - protein, 106 aa, Homo sapiens
  Payload ID: 4001
  Gene Symbol: COX16
  Gene Name: COX16 cytochrome c oxidase assembly homolog
  Uniprot ID: Q9P0S2
  ENSP ID: ENSP00000374562
MFAPAVMRAFRKNKTLGYGVPMLLLIVGGSFGLREFSQIRYDAVKSKMDPELEKKLKENKISLESEYEKIKDSKFDDWKNIRGPRPWEDPDLLQGRNPESLKTKTT

SEQ ID NO: 20097 - protein, 25 aa, Homo sapiens
  Payload ID: 4001
  Gene Symbol: COX16
  Gene Name: COX16 cytochrome c oxidase assembly homolog
  ENSP ID: ENSP00000450871
MFAPAVMRAFRKNKTLGYGVPMLVY

SEQ ID NO: 20098 - protein, 63 aa, Homo sapiens
  Payload ID: 4002
  Gene Symbol: COX17
  Gene Name: COX17 cytochrome c oxidase copper chaperone
  Uniprot ID: Q14061
  ENSP ID: ENSP00000261070
MPGLVDSNPAPPESQEKKPLKPCCACPETKKARDACIIEKGEEHCGHLIEAHKECMRALGFKI

SEQ ID NO: 20099 - protein, 58 aa, Homo sapiens
  Payload ID: 4002
  Gene Symbol: COX17
  Gene Name: COX17 cytochrome c oxidase copper chaperone
  ENSP ID: ENSP00000417120
  MOD_RES (1)..(1): Any amino acid
XSNPAPPESQEKKPLKPCCACPETKKARDACIIEKGEEHCGHLIEAHKECMRALGFKI

SEQ ID NO: 20100 - protein, 98 aa, Homo sapiens
  Payload ID: 4002
  Gene Symbol: COX17
  Gene Name: COX17 cytochrome c oxidase copper chaperone
  ENSP ID: ENSP00000417651
MPGLVDSNPAPPESQEKKPLKPCCACPETKKARDAWFRGRVSVDLSRSLVPGNDGERGERQASTTHSFLQIIIEKGEEHCGHLIEAHKECMRALGFKI

SEQ ID NO: 20101 - protein, 63 aa, Homo sapiens; identical to SEQ ID NO: 20098
  Payload ID: 4002
  Gene Symbol: COX17
  Gene Name: COX17 cytochrome c oxidase copper chaperone
  Uniprot ID: Q14061
  ENSP ID: ENSP00000417805

SEQ ID NO: 20102 - protein, 63 aa, Homo sapiens; identical to SEQ ID NO: 20098
  Payload ID: 4002
  Gene Symbol: COX17
  Gene Name: COX17 cytochrome c oxidase copper chaperone
  Uniprot ID: Q14061
  ENSP ID: ENSP00000417923

SEQ ID NO: 20103 - protein, 45 aa, Homo sapiens
  Payload ID: 4002
  Gene Symbol: COX17
  Gene Name: COX17 cytochrome c oxidase copper chaperone
  ENSP ID: ENSP00000420406
  MOD_RES (1)..(1): Any amino acid
XGNDGERGERQASTTHSFLQMCVEYLLWVKHCVRSEDVDMDKDAS

SEQ ID NO: 20104 - protein, 333 aa, Homo sapiens
  Payload ID: 4003
  Gene Symbol: COX18
  Gene Name: COX18 cytochrome c oxidase assembly factor
  Uniprot ID: Q8N8Q8
  ENSP ID: ENSP00000295890
MLCRLGGRWLRPLPALQLWARDLPLAPVPTSGAKRPTLPVWAVAPVSAVHANGWYEALAASSPVRVAEEVLLGVHAATGLPWWGSILLSTVALRGAVTLPLAAYQHYILAKVENLQPEIKTIARHLNQEVAVRANQLGWSKRDARLTYLKNMRRLISELYVRDNCHPFKATVLVWIQLPMWIFMSFALRNLSTGAAHSEGFSVQEQLATGGILWFPDLTAPDSTWILPISVGVINLLIVEICALQKIGMSRFQTYITYFVRAMSVLMIPIAATVPSSIVLYWLCSSFVGLSQNLLLRSPGFRQLCRIPSTKSDSETPYKDIFAAFNTKFISRK

SEQ ID NO: 20105 - protein, 129 aa, Homo sapiens
  Payload ID: 4003
  Gene Symbol: COX18
  Gene Name: COX18 cytochrome c oxidase assembly factor
  Uniprot ID: Q8N8Q8
  ENSP ID: ENSP00000394583
MLCRLGGRWLRPLPALQLWARDLPLAPVPTSGAKRPTLPVWAVAPVSAVHANGWYEALAASSPVRVAEEVLLGVHAATGLPWWGSILLSTVALRGAVTLPLAAYQHYILAKAHLSKEYEEANFRAICAR

SEQ ID NO: 20106 - protein, 127 aa, Homo sapiens
  Payload ID: 4003
  Gene Symbol: COX18
  Gene Name: COX18 cytochrome c oxidase assembly factor
  Uniprot ID: Q8N8Q8
  ENSP ID: ENSP00000424978
MLCRLGGRWLRPLPALQLWARDLPLAPVPTSGAKRPTLPVWAVAPVSAVHANGWYEALAASSPVRVAEEVLLGVHAATGLPWWGSILLSTVALRGAVTLPLAAYQHYILAKLGGKFAARNKNYCQAS

SEQ ID NO: 20107 - protein, 334 aa, Homo sapiens
  Payload ID: 4003
  Gene Symbol: COX18
  Gene Name: COX18 cytochrome c oxidase assembly factor
  ENSP ID: ENSP00000425261
MLCRLGGRWLRPLPALQLWARDLPLAPVPTSGAKRPTLPVWAVAPVSAVHANGWYEALAASSPVRVAEEVLLGVHAATGLPWWGSILLSTVALRGAVTLPLAAYQHYILAKVENLQPEIKTIARHLNQEVAVRANQLGWSKRDARLTYLKNMRRLISELYVRDNCHPFKATVLVWIQLPMWIFMSFALRNLSTGAAHSEAGFSVQEQLATGGILWFPDLTAPDSTWILPISVGVINLLIVEICALQKIGMSRFQTYITYFVRAMSVLMIPIAATVPSSIVLYWLCSSFVGLSQNLLLRSPGFRQLCRIPSTKSDSETPYKDIFAAFNTKFISRK

SEQ ID NO: 20108 - protein, 90 aa, Homo sapiens
  Payload ID: 4004
  Gene Symbol: COX19
  Gene Name: COX19 cytochrome c oxidase assembly factor
  Uniprot ID: Q49B96
  ENSP ID: ENSP00000342015
MSTAMNFGTKSFQPRPPDKGSFPLDHLGECKSFKEKFMKCLHNNNFENALCRKESKEYLECRMERKLMLQEPLEKLGFGDLTSGKSEAKK

SEQ ID NO: 20109 - protein, 122 aa, Homo sapiens
  Payload ID: 4004
  Gene Symbol: COX19
  Gene Name: COX19 cytochrome c oxidase assembly factor
  ENSP ID: ENSP00000413423
MSTAMNFGTKSFQPRPPDKGSFPLDHLGECKSFKEKFMKCLHNNNFENALCRKESKEYLECRMERSRLGLLHSGRLHLPELLGNPPEYPPGQQGEVRPPGRLGGGPSGVHGLPRERRRESQV

SEQ ID NO: 20110 - protein, 130 aa, Homo sapiens
  Payload ID: 4005
  Gene Symbol: COX20
  Gene Name: COX20 cytochrome c oxidase assembly factor
  Uniprot ID: Q5RI15
  ENSP ID: ENSP00000355486
MAAPPEPGEPEERKASCTSLHLSYWKSLKLLGFLDVENTPCARHSILYGSLGSVVAGFGHFLFTSRIRRSCDVGVGGFILVTLGCWFHCRYNYAKQRIQERIAREEIKKKILYEGTHLDPERKHNGSSSN

SEQ ID NO: 20111 - protein, 118 aa, Homo sapiens
  Payload ID: 4005
  Gene Symbol: COX20
  Gene Name: COX20 cytochrome c oxidase assembly factor
  Uniprot ID: Q5RI15
  ENSP ID: ENSP00000406327
MAAPPEPGEPEERKSLKLLGFLDVENTPCARHSILYGSLGSVVAGFGHFLFTSRIRRSCDVGVGGFILVTLGCWFHCRYNYAKQRIQERIAREEIKKKILYEGTHLDPERKHNGSSSN

SEQ ID NO: 20112 - protein, 365 aa, Homo sapiens
  Payload ID: 4006
  Gene Symbol: CXADR
  Gene Name: coxsackie virus and adenovirus receptor
  Uniprot ID: P78310
  ENSP ID: ENSP00000284878
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 20113 - protein, 89 aa, Homo sapiens
  Payload ID: 4006
  Gene Symbol: CXADR
  Gene Name: coxsackie virus and adenovirus receptor
  Uniprot ID: P78310
  ENSP ID: ENSP00000348620
MALLLCFVLLCGVVDFARSLSITTPEEMIEKAKGETAYLPCKFTLSPEDQGPLDIEWLISPADNQKVDQVGRCATSKEPYVHCQKLHRQ

SEQ ID NO: 20114 - protein, 200 aa, Homo sapiens
  Payload ID: 4006
  Gene Symbol: CXADR
  Gene Name: coxsackie virus and adenovirus receptor
  Uniprot ID: P78310
  ENSP ID: ENSP00000383029
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLGKMCHLQRAVRPLPEATSAVIIHPWGPCLLPTWKDIPRLSITKYQVKTLNALLRVRLSHLLR

SEQ ID NO: 20115 - protein, 252 aa, Homo sapiens
  Payload ID: 4006
  Gene Symbol: CXADR
  Gene Name: coxsackie virus and adenovirus receptor
  Uniprot ID: P78310
  ENSP ID: ENSP00000383030
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAGKMCHLQRAVRPLPEATSAVIIHPWGPCLLPTWKDIPRLSITKYQVKTLNALLRVRLSHLLR

SEQ ID NO: 20116 - protein, 352 aa, Homo sapiens
  Payload ID: 4006
  Gene Symbol: CXADR
  Gene Name: coxsackie virus and adenovirus receptor
  Uniprot ID: P78310
  ENSP ID: ENSP00000383033
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKFKYPYKTDGITVV

SEQ ID NO: 20117 - protein, 589 aa, Homo sapiens
  Payload ID: 4007
  Gene Symbol:
  Gene Name: CPEB2
  ENSP ID: ENSP00000488925
MPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRSSLQLPAWGSDSLQDSWCTAAGTSRIDQDRSRMYDSLNMHSLENSLIDIMRAEHDPLKGRLSYPHPGTDNLLMLNGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 20118 - protein, 167 aa, Homo sapiens
  Payload ID: 4007
  Gene Symbol:
  Gene Name: CPEB2
  ENSP ID: ENSP00000489113
ITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKR

SEQ ID NO: 20119 - protein, 559 aa, Homo sapiens
  Payload ID: 4007
  Gene Symbol:
  Gene Name: CPEB2
  ENSP ID: ENSP00000489160
MPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQDRSRMYDSLNMHSLENSLIDIMRAEHDPLKGRLSYPHPGTDNLLMLNGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 20120 - protein, 1007 aa, Homo sapiens
  Payload ID: 4007
  Gene Symbol:
  Gene Name: CPEB2
  ENSP ID: ENSP00000489336
MRDFGFGVLQTAPLRSSSPGPLFCGEAYGPYAVGSVNPLPSATPFGPLSPPPLPVTGFLEAASPFSVPLGGGAGSPAAAASSSSPFLAHQQTMQDELLLGLTQQPARPLSGAAATEKLPDHHPGGGTIAGVTHLLPSQDFKPSLHHPSSSSASSCCCCRTSSPQDFSKRQQQQLSSQKRKEFSPPHLPHPPDSKPPPPPPPLHCPGRFSPPPPPAGPLLQPAQLAQRQQQQPPQQFSLLHQQHLSPQDFAPRQRPADLPPLPQLPPSPPAAPRRRHGGAGSPRKTPAAGEGSAAESPNAGLASSTPVNPAPGSMESPNHPLLNSPSNLLPGGALGAGAFSSLQSPDLPHPGGGGGGGGGGPPGGGGGGGSASPPPLPGFGTPWSVQTASPPPQPQQPPPTQPQQQPPPPQQPPQPQPQPPGSSATTPGGGSGGSLSAMPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRMDRSRMYDSLNMHSLENSLIDIMRAEHDPLKGRLSYPHPGTDNLLMLNARSYGRRRGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 20121 - protein, 562 aa, Homo sapiens
  Payload ID: 4007
  Gene Symbol:
  Gene Name: CPEB2
  ENSP ID: ENSP00000489362
MPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRMDRSRMYDSLNMHSLENSLIDIMRAEHDPLKGRLSYPHPGTDNLLMLNGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 20122 - protein, 567 aa, Homo sapiens
  Payload ID: 4007
  Gene Symbol:
  Gene Name: CPEB2
  ENSP ID: ENSP00000489406
MPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQDRSRMYDSLNMHSLENSLIDIMRAEHDPLKGRLSYPHPGTDNLLMLNARSYGRRRGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 20123 - protein, 1034 aa, Homo sapiens
  Payload ID: 4007
  Gene Symbol:
  Gene Name: CPEB2
  ENSP ID: ENSP00000489427
MRDFGFGVLQTAPLRSSSPGPLFCGEAYGPYAVGSVNPLPSATPFGPLSPPPLPVTGFLEAASPFSVPLGGGAGSPAAAASSSSPFLAHQQTMQDELLLGLTQQPARPLSGAAATEKLPDHHPGGGTIAGVTHLLPSQDFKPSLHHPSSSSASSCCCCRTSSPQDFSKRQQQQLSSQKRKEFSPPHLPHPPDSKPPPPPPPLHCPGRFSPPPPPAGPLLQPAQLAQRQQQQPPQQFSLLHQQHLSPQDFAPRQRPADLPPLPQLPPSPPAAPRRRHGGAGSPRKTPAAGEGSAAESPNAGLASSTPVNPAPGSMESPNHPLLNSPSNLLPGGALGAGAFSSLQSPDLPHPGGGGGGGGGGPPGGGGGGGSASPPPLPGFGTPWSVQTASPPPQPQQPPPTQPQQQPPPPQQPPQPQPQPPGSSATTPGGGSGGSLSAMPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRSSLQLPAWGSDSLQDSWCTAAGTSRIDQDRSRMYDSLNMHSLENSLIDIMRAEHDPLKGRLSYPHPGTDNLLMLNARSYGRRRGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 20124 - protein, 597 aa, Homo sapiens
  Payload ID: 4007
  Gene Symbol:
  Gene Name: CPEB2
  ENSP ID: ENSP00000489471
MPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRSSLQLPAWGSDSLQDSWCTAAGTSRIDQDRSRMYDSLNMHSLENSLIDIMRAEHDPLKGRLSYPHPGTDNLLMLNARSYGRRRGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 20125 - protein, 301 aa, Homo sapiens
  Payload ID: 4008
  Gene Symbol: CPXCR1
  Gene Name: CPX chromosome region, candidate 1
  Uniprot ID: Q8N123
  ENSP ID: ENSP00000276127
MSYPTKEGSDTAGNAHKNSENEPPNDCSTDIESPSADPNMIYQVETNPINREPGTATSQEDVVPQAAENSELETEIQKDQREEDLKEELLLLQTPIPRKLVSHKPLNDRSRSHSGKVEMKANNFPINHKTRFRLSTSWRVPFINSHEIRSMILHLLCDRYFSQAAGCQNTMWVKRKYIACLYHPNSFTHHERAITFRRPSRVHYYRPLTERMTSGKFCKSTDTKGKCRFRAIVRSVLFVSQIQIESIFNIKGFVDILTYIHTMNVMITNTNNGWKYFCPICGRLFNTYSELRQHSCSSSGN

SEQ ID NO: 20126 - protein, 301 aa, Homo sapiens; identical to SEQ ID NO: 20125
  Payload ID: 4008
  Gene Symbol: CPXCR1
  Gene Name: CPX chromosome region, candidate 1
  Uniprot ID: Q8N123
  ENSP ID: ENSP00000362203

SEQ ID NO: 20127 - protein, 301 aa, Homo sapiens; identical to SEQ ID NO: 20125
  Payload ID: 4008
  Gene Symbol: CPXCR1
  Gene Name: CPX chromosome region, candidate 1
  Uniprot ID: Q8N123
  ENSP ID: ENSP00000484986

SEQ ID NO: 20128 - protein, 137 aa, Homo sapiens; identical to SEQ ID NO: 3750
  Payload ID: 4009
  Gene Symbol:
  Gene Name: CR388407.1
  ENSP ID: ENSP00000480438

SEQ ID NO: 20129 - protein, 167 aa, Homo sapiens [sequence omitted]

SEQ ID NO: 20130 - protein, 137 aa, Homo sapiens; identical to SEQ ID NO: 3750
  Payload ID: 4011
  Gene Symbol:
  Gene Name: CR547123.1
  ENSP ID: ENSP00000477901

SEQ ID NO: 20131 - protein, 23 aa, Homo sapiens
  Payload ID: 4012
  Gene Symbol:
  Gene Name: CR753845.1
  ENSP ID: ENSP00000469236
PTLCCLSCFSSLWPRWEDHLRPG

SEQ ID NO: 20132 - protein, 36 aa, Homo sapiens
  Payload ID: 4013
  Gene Symbol:
  Gene Name: CR759815.1
  ENSP ID: ENSP00000447586
SPPPPGGGEKPLAPPPGWVEPPKWLGLQGPSGGPGV

SEQ ID NO: 20133 - protein, 36 aa, Homo sapiens; identical to SEQ ID NO: 20132
  Payload ID: 4014
  Gene Symbol:
  Gene Name: CR847794.1
  ENSP ID: ENSP00000447114

SEQ ID NO: 20134 - protein, 137 aa, Homo sapiens; identical to SEQ ID NO: 3750
  Payload ID: 4015
  Gene Symbol:
  Gene Name: CR933783.1
  ENSP ID: ENSP00000483939

SEQ ID NO: 20135 - protein, 1269 aa, Homo sapiens
  Payload ID: 4016
  Gene Symbol: CRAMP1
  Gene Name: cramped chromatin regulator homolog 1
  Uniprot ID: Q96RY5
  ENSP ID: ENSP00000293925
MTVKLGDGGSGEDGLKKLGKRAADEESLEGEGAGGADAAEESSGTKRDEKTPRAGADGPPAPPGAPQAPSPPQGSPQDQHHFLRSSVRPQSKRPRKDPPSAVGSGNAGGSGPRGKGAEGGGSSSGNVSGVAPAAPAGGSRSSSRNLGSSGGEKEEGKKVRRQWESWSTEDKNTFFEGLYEHGKDFEAIQNNIALKYKKKGKPASMVKNKEQVRHFYYRTWHKITKYIDFDHVFSRGLKKSSQELYGLICYGELRKKIGGCMDDKNATKLNELIQVGATTVRYKGRNLRIKAPMCRALKKLCDPDGLSDEEDQKPVRLPLKVPIELQPRNNHAWARVQSLAQNPRLRMIVELHRKVSSLIEFLKQKWALHEVRVRKTLEERQLQDSCSAPMQEKVTLHLFPGENCTLTPLPGVARVVHSKAFCTVHWQEGGRCKQSAKDAHVLPPAQILGIQSGQGTARGQVKCPRSGAEGKGVGRPPPAADALQSSGESSPESAPGEGAALSLSSPDAPDRPPPRHQDTGPCLEKTPAEGRDSPTREPGALPCACGQLPDLEDELSLLDPLPRYLKSCQDLIVPEQCRCADTRPGSEQPPLGGAASPEVLAPVSKEAADLAPTGPSPRPGPGLLLDVCTKDLADAPAEELQEKGSPAGPPPSQGQPAARPPKEVPASRLAQQLREEGWNLQTSESLTLAEVYLMMGKPSKLQLEYDWLGPGRQDPRPGSLPTALHKQRLLSCLLKLISTEVNPKLALEANTISTASVRPAQEEQSMTPPGKVVTVSSRSPRCPRNQASLRSSKTFPPSSAPCSSGLRNPPRPLLVPGPSSTGSNDSDGGLFAVPTTLPPNSRHGKLFSPSKEAELTFRQHLNSISMQSDFFLPKPRKLRNRHLRKPLVVQRTLLPRPSENQSHNVCSFSILSNSSVTGRGSFRPIQSSLTKAALSRPIVPKVLPPQATSHLASAIDLAATSAGILSGNPLPALDTEGLSGISPLSSDEVTGAISGQDSTGTHQDGDTLPTVGGSDPFVSIPSRPEQEPVADSFQGSSVLSLSELPKAPLQNGLSIPLSSSESSSTRLSPPDVSALLDISLPGPPEDALSQGEPATHISDSIIEIAISSGQYGEGVPLSPAKLNGSDSSKSLPSPSSSPQPHWIASPTHDPQWYPSDSTDSSLSSLFASFISPEKSRKMLPTPIGTNSGTSLLGPSLLDGNSRDSFVSRSLADVAEVVDSQLVCMMNENSIDYISRFNDLAQELSIAEPGRREALFDGGGGGPAVSDLSQ

SEQ ID NO: 20136 - protein, 1269 aa, Homo sapiens; identical to SEQ ID NO: 20135
  Payload ID: 4016
  Gene Symbol: CRAMP1
  Gene Name: cramped chromatin regulator homolog 1
  Uniprot ID: Q96RY5
  ENSP ID: ENSP00000380559

SEQ ID NO: 20137 - protein, 184 aa, Homo sapiens
  Payload ID: 4016
  Gene Symbol: CRAMP1
  Gene Name: cramped chromatin regulator homolog 1
  ENSP ID: ENSP00000399172
  MOD_RES (1)..(1): Any amino acid
XGKLFSPSKEAELTFRQHLNSISMQSDFFLPKPRKLRNRHLRKPLVVQRTLLPRPSENQSHNVCSFSILSNSSVTGAIDLAATSAGILSGNPLPALDTEGLSGISPLSSDEVTGAISGQDSTGTHQDGDTLPTVGGSSVLSLSELPKAPLQNGLSIPLSSSESSSTRLSPPDVSALLDISLPGP

SEQ ID NO: 20138 - protein, 299 aa, Homo sapiens
  Payload ID: 4017
  Gene Symbol: CFDP1
  Gene Name: craniofacial development protein 1
  Uniprot ID: Q9UEE9
  ENSP ID: ENSP00000283882
MEEFDSEDFSTSEEDEDYVPSGGEYSEDDVNELVKEDEVDGEEQTQKTQGKKRKAQSIPARKRRQGGLSLEEEEEEDANSESEGSSSEEEDDAAEQEKGIGSEDARKKKEDELWASFLNDVGPKSKVPPSTQVKKGEETEETSSSKLLVKAEELEKPKETEKVKITKVFDFAGEEVRVTKEVDATSKEAKSFFKQNEKEKPQANVPSALPSLPAGSGLKRSSGMSSLLGKIGAKKQKMSTLEKSKLDWESFKEEEGIGEELAIHNRGKEGYIERKAFLDRVDHRQFEIERDLRLSKMKP

SEQ ID NO: 20139 - protein, 50 aa, Homo sapiens
  Payload ID: 4017
  Gene Symbol: CFDP1
  Gene Name: craniofacial development protein 1
  ENSP ID: ENSP00000455564
MSRRPAYCSLQFLGSSDPPASASPVDGTTGGEYSEDDVNELVKEDEVDGE

SEQ ID NO: 20140 - protein, 19 aa, Homo sapiens
  Payload ID: 4017
  Gene Symbol: CFDP1
  Gene Name: craniofacial development protein 1
  ENSP ID: ENSP00000462862
QANVPSALPSLPAGSGCVI

SEQ ID NO: 20141 - protein, 17 aa, Homo sapiens
  Payload ID: 4017
  Gene Symbol: CFDP1
  Gene Name: craniofacial development protein 1
  ENSP ID: ENSP00000481200
  MOD_RES (1)..(1): Any amino acid
XALPSLPAGSGKKKFDA

SEQ ID NO: 20142 - protein, 224 aa, Homo sapiens
  Payload ID: 4018
  Gene Symbol: CRP
  Gene Name: C-reactive protein, pentraxin-related
  Uniprot ID: P02741
  ENSP ID: ENSP00000255030
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRKSLKKGYTVGAEASIILGQEQDSFGGNFEGSQSLVGDIGNVNMWDFVLSPDEINTIYLGGPFSPNVLNWRALKYEVQGEVFTKPQLWP

SEQ ID NO: 20143 - protein, 102 aa, Homo sapiens
  Payload ID: 4018
  Gene Symbol: CRP
  Gene Name: C-reactive protein, pentraxin-related
  ENSP ID: ENSP00000357091
MEKLLCFLVLTSLSHAFGQTDMSRKAFVFPKESDTSYVSLKAPLTKPLKAFTVCLHFYTELSSTHEINTIYLGGPFSPNVLNWRALKYEVQGEVFTKPQLWP

SEQ ID NO: 20144 - protein, 102 aa, Homo sapiens; identical to SEQ ID NO: 20143
  Payload ID: 4018
  Gene Symbol: CRP
  Gene Name: C-reactive protein, pentraxin-related
  ENSP ID: ENSP00000357092

SEQ ID NO: 20145 - protein, 91 aa, Homo sapiens
  Payload ID: 4018
  Gene Symbol: CRP
  Gene Name: C-reactive protein, pentraxin-related
  Uniprot ID: P02741
  ENSP ID: ENSP00000357093
MEKLLCFLVLTSLSHAFGQTDMSRKAFVFPKESDTSYVSLKAPLTKPLKAFTVCLHFYTELSSTRGPNVLNWRALKYEVQGEVFTKPQLWP

SEQ ID NO: 20146 - protein, 46 aa, Homo sapiens
  Payload ID: 4018
  Gene Symbol: CRP
  Gene Name: C-reactive protein, pentraxin-related
  ENSP ID: ENSP00000402788
MWDFVLSPDEINTIYLGGPFSPNVLNWRALKYEVQGEVFTKPQLWP

SEQ ID NO: 20147 - protein, 381 aa, Homo sapiens
  Payload ID: 4019
  Gene Symbol: CKB
  Gene Name: creatine kinase, brain
  Uniprot ID: P12277
  ENSP ID: ENSP00000299198
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKPVSPLLLASGMARDWPDARGIWHNDNKTFLVWVNEEDHLRVISMQKGGNMKEVFTRFCTGLTQIETLFKSKDYEFMWNPHLGYILTCPSNLGTGLRAGVHIKLPNLGKHEKFSEVLKRLRLQKRGTGGVDTAAVGGVFDVSNADRLGFSEVELVQMVVDGVKLLIEMEQRLEQGQAIDDLMPAQK

SEQ ID NO: 20148 - protein, 58 aa, Homo sapiens
  Payload ID: 4019
  Gene Symbol: CKB
  Gene Name: creatine kinase, brain
  ENSP ID: ENSP00000450676
MPFSNSHNALKLRFPAEDEPPVHHDRGLRGGRRGVLRSVQGSLRPHHRGPARRLQAQR

SEQ ID NO: 20149 - protein, 179 aa, Homo sapiens
  Payload ID: 4019
  Gene Symbol: CKB
  Gene Name: creatine kinase, brain
  ENSP ID: ENSP00000451426
FLFDKPVSPLLLASGMARDWPDARGIWHNDNKTFLVWVNEEDHLRVISMQKGGNMKEIETLFKSKDYEFMWNPHLGYILTCPSNLGTGLRAGVHIKLPNLGKHEKFSEVLKRLRLQKRGTGGVDTAAVGGVFDVSNADRLGFSEVELVQMVVDGVKLLIEMEQRLEQGQAIDDLMPAQK

SEQ ID NO: 20150 - protein, 128 aa, Homo sapiens
  Payload ID: 4019
  Gene Symbol: CKB
  Gene Name: creatine kinase, brain
  ENSP ID: ENSP00000451611
MAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKL

SEQ ID NO: 20151 - protein, 20 aa, Homo sapiens
  Payload ID: 4019
  Gene Symbol: CKB
  Gene Name: creatine kinase, brain
  ENSP ID: ENSP00000451680
  MOD_RES (1)..(1): Any amino acid
XSPLLLASGMARDWPDARGI

SEQ ID NO: 20152 - protein, 90 aa, Homo sapiens
  Payload ID: 4019
  Gene Symbol: CKB
  Gene Name: creatine kinase, brain
  ENSP ID: ENSP00000451686
  MOD_RES (1)..(1): Any amino acid
XPAPVTLAEQIETLFKSKDYEFMWNPHLGYILTCPSNLGTGLRAGVHIKLPNLGKHEKFSEVLKRLRLQKRGTGGVDTAAVGGVFDVSNA

SEQ ID NO: 20153 - protein, 217 aa, Homo sapiens
  Payload ID: 4019
  Gene Symbol: CKB
  Gene Name: creatine kinase, brain
  ENSP ID: ENSP00000451904
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKPVSPLLLASGMARDWPDARGI

SEQ ID NO: 20154 - protein, 69 aa, Homo sapiens
  Payload ID: 4020
  Gene Symbol: CKMT1A
  Gene Name: creatine kinase, mitochondrial 1A
  ENSP ID: ENSP00000389806
MAGPFSRLLSARPGLRLLALAGAGSLAAGFLLRPEPVRAASERRRLYPPRLFPSSIRSVVSWEERTEQI

SEQ ID NO: 20155 - protein, 148 aa, Homo sapiens
  Payload ID: 4020
  Gene Symbol: CKMT1A
  Gene Name: creatine kinase, mitochondrial 1A
  ENSP ID: ENSP00000398973
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASK

SEQ ID NO: 20156 - protein, 221 aa, Homo sapiens
  Payload ID: 4020
  Gene Symbol: CKMT1A
  Gene Name: creatine kinase, mitochondrial 1A
  ENSP ID: ENSP00000401927
MAGPFSRLLSARPGLRLLALAGAGSLAAGFLLRPEPVRAASERRRLYPPSQTWPTGQLPGNCTRSRRLCPPSMVTGYPLPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERV

SEQ ID NO: 20157 - protein, 417 aa, Homo sapiens
  Payload ID: 4020
  Gene Symbol: CKMT1A
  Gene Name: creatine kinase, mitochondrial 1A
  Uniprot ID: P12532
  ENSP ID: ENSP00000406577
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVERLIQERGWEFMWNERLGYILTCPSNLGTGLRAGVHIKLPLLSKDSRFPKILENLRLQKRGTGGVDTAATGGVFDISNLDRLGKSEVELVQLVIDGVNYLIDCERRLERGQDIRIPTPVIHTKH

SEQ ID NO: 20158 - protein, 417 aa, Homo sapiens; identical to SEQ ID NO: 20157
  Payload ID: 4020
  Gene Symbol: CKMT1A
  Gene Name: creatine kinase, mitochondrial 1A
  Uniprot ID: P12532
  ENSP ID: ENSP00000413165

SEQ ID NO: 20159 - protein, 298 aa, Homo sapiens
  Payload ID: 4020
  Gene Symbol: CKMT1A
  Gene Name: creatine kinase, mitochondrial 1A
  ENSP ID: ENSP00000487331
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVVVGIK

SEQ ID NO: 20160 - protein, 417 aa, Homo sapiens; identical to SEQ ID NO: 20157
  Payload ID: 4021
  Gene Symbol: CKMT1B
  Gene Name: creatine kinase, mitochondrial 1B
  Uniprot ID: P12532
  ENSP ID: ENSP00000300283

SEQ ID NO: 20161 - protein, 129 aa, Homo sapiens
  Payload ID: 4021
  Gene Symbol: CKMT1B
  Gene Name: creatine kinase, mitochondrial 1B
  ENSP ID: ENSP00000391990
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQER

SEQ ID NO: 20162 - protein, 103 aa, Homo sapiens
  Payload ID: 4021
  Gene Symbol: CKMT1B
  Gene Name: creatine kinase, mitochondrial 1B
  ENSP ID: ENSP00000396707
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIK

SEQ ID NO: 20163 - protein, 58 aa, Homo sapiens
  Payload ID: 4021
  Gene Symbol: CKMT1B
  Gene Name: creatine kinase, mitochondrial 1B
  ENSP ID: ENSP00000399467
MAGPFSRLLSARPGLRLLALAGAGSLAAGFLLRPEPVRAASERRRLYPPRYLLTCLTL

SEQ ID NO: 20164 - protein, 203 aa, Homo sapiens
  Payload ID: 4021
  Gene Symbol: CKMT1B
  Gene Name: creatine kinase, mitochondrial 1B
  ENSP ID: ENSP00000411531
MAGPFSRLLSARPGLRLLALAGAGSLAAGFLLRPEPVRAASERRRLYPPSQTWPTGQLPGNCTRSRRLCPPSMVTGYPLPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRG

SEQ ID NO: 20165 - protein, 417 aa, Homo sapiens; identical to SEQ ID NO: 20157
  Payload ID: 4021
  Gene Symbol: CKMT1B
  Gene Name: creatine kinase, mitochondrial 1B
  Uniprot ID: P12532
  ENSP ID: ENSP00000413255

SEQ ID NO: 20166 - protein, 241 aa, Homo sapiens
  Payload ID: 4021
  Gene Symbol: CKMT1B
  Gene Name: creatine kinase, mitochondrial 1B
  ENSP ID: ENSP00000413999
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMA

SEQ ID NO: 20167 - protein, 96 aa, Homo sapiens
  Payload ID: 4021
  Gene Symbol: CKMT1B
  Gene Name: creatine kinase, mitochondrial 1B
  ENSP ID: ENSP00000416467
MAGPFSRLLSARPGLRLLALAGAGSLAAGFLLRPEPVRAASERRRLYPPSQTWPTGQLPGNCTRSRRLCPPSMVTGYPLPSAEYPDLRKHNNCMAS

SEQ ID NO: 20168 - protein, 298 aa, Homo sapiens; identical to SEQ ID NO: 20159
  Payload ID: 4021
  Gene Symbol: CKMT1B
  Gene Name: creatine kinase, mitochondrial 1B
  ENSP ID: ENSP00000416717

SEQ ID NO: 20169 - protein, 298 aa, Homo sapiens; identical to SEQ ID NO: 20159
  Payload ID: 4021
  Gene Symbol: CKMT1B
  Gene Name: creatine kinase, mitochondrial 1B
  ENSP ID: ENSP00000486477

SEQ ID NO: 20170 - protein, 419 aa, Homo sapiens
  Payload ID: 4022
  Gene Symbol: CKMT2
  Gene Name: creatine kinase, mitochondrial 2 (sarcomeric)
  Uniprot ID: P17540
  ENSP ID: ENSP00000254035
MASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVERLIQERGWEFMWNERLGYILTCPSNLGTGLRAGVHVRIPKLSKDPRFSKILENLRLQKRGTGGVDTAAVADVYDISNIDRIGRSEVELVQIVIDGVNYLVDCEKKLERGQDIKVPPPLPQFGKK

SEQ ID NO: 20171 - protein, 419 aa, Homo sapiens; identical to SEQ ID NO: 20170
  Payload ID: 4022
  Gene Symbol: CKMT2
  Gene Name: creatine kinase, mitochondrial 2 (sarcomeric)
  Uniprot ID: P17540
  ENSP ID: ENSP00000404203

SEQ ID NO: 20172 - protein, 419 aa, Homo sapiens; identical to SEQ ID NO: 20170
  Payload ID: 4022
  Gene Symbol: CKMT2
  Gene Name: creatine kinase, mitochondrial 2 (sarcomeric)
  Uniprot ID: P17540
  ENSP ID: ENSP00000410289

SEQ ID NO: 20173 - protein, 170 aa, Homo sapiens
  Payload ID: 4022
  Gene Symbol: CKMT2
  Gene Name: creatine kinase, mitochondrial 2 (sarcomeric)
  ENSP ID: ENSP00000423264
MASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRS

SEQ ID NO: 20174 - protein, 157 aa, Homo sapiens
  Payload ID: 4022
  Gene Symbol: CKMT2
  Gene Name: creatine kinase, mitochondrial 2 (sarcomeric)
  ENSP ID: ENSP00000427635
MASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKDHFLFDKP

SEQ ID NO: 20175 - protein, 381 aa, Homo sapiens
  Payload ID: 4023
  Gene Symbol: CKM
  Gene Name: creatine kinase, muscle
  Uniprot ID: P06732
  ENSP ID: ENSP00000221476
MPFGNTHNKFKLNYKPEEEYPDLSKHNNHMAKVLTLELYKKLRDKETPSGFTVDDVIQTGVDNPGHPFIMTVGCVAGDEESYEVFKELFDPIISDRHGGYKPTDKHKTDLNHENLKGGDDLDPNYVLSSRVRTGRSIKGYTLPPHCSRGERRAVEKLSVEALNSLTGEFKGKYYPLKSMTEKEQQQLIDDHFLFDKPVSPLLLASGMARDWPDARGIWHNDNKSFLVWVNEEDHLRVISMEKGGNMKEVFRRFCVGLQKIEEIFKKAGHPFMWNQHLGYVLTCPSNLGTGLRGGVHVKLAHLSKHPKFEEILTRLRLQKRGTGGVDTAAVGSVFDVSNADRLGSSEVEQVQLVVDGVKLMVEMEKKLEKGQSIDDMIPAQK

SEQ ID NO: 20176 - protein, 2442 aa, Homo sapiens
  Payload ID: 4024
  Gene Symbol: CREBBP
  Gene Name: CREB binding protein
  Uniprot ID: Q92793
  ENSP ID: ENSP00000262367
MAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 20177 - protein, 2404 aa, Homo sapiens
  Payload ID: 4024
  Gene Symbol: CREBBP
  Gene Name: CREB binding protein
  Uniprot ID: Q92793
  ENSP ID: ENSP00000371502
MAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQAILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 20178 - protein, 254 aa, Homo sapiens
  Payload ID: 4024
  Gene Symbol: CREBBP
  Gene Name: CREB binding protein
  ENSP ID: ENSP00000458254
  MOD_RES (1)..(1): Any amino acid
XDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPRMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQVLCPTGTVAP

SEQ ID NO: 20179 - protein, 181 aa, Homo sapiens
  Payload ID: 4024
  Gene Symbol: CREBBP
  Gene Name: CREB binding protein
  ENSP ID: ENSP00000459490
  MOD_RES (1)..(1): Any amino acid
XHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQVLCPTGTVAP

SEQ ID NO: 20180 - protein, 196 aa, Homo sapiens
  Payload ID: 4024
  Gene Symbol: CREBBP
  Gene Name: CREB binding protein
  ENSP ID: ENSP00000460474
  MOD_RES (1)..(1): Any amino acid
XRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTR

SEQ ID NO: 20181 - protein, 1105 aa, Homo sapiens
  Payload ID: 4024
  Gene Symbol: CREBBP
  Gene Name: CREB binding protein
  ENSP ID: ENSP00000461002
NATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNSSPKYGLLADRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEE

SEQ ID NO: 20182 - protein, 634 aa, Homo sapiens
  Payload ID: 4025
  Gene Symbol: CRTC1
  Gene Name: CREB regulated transcription coactivator 1
  Uniprot ID: Q6UUV9
  ENSP ID: ENSP00000323332
MATSNNPRKFSEKIALHNQKQAEETAAFEEVMKDLSLTRAARLQLQKSQYLQLGPSRGQYYGGSLPNVNQIGSGTMDLPFQTPFQSSGLDTSRTTRHHGLVDRVYRERGRLGSPHRRPLSVDKHGRQADSCPYGTMYLSPPADTSWRRTNSDSALHQSTMTPTQPESFSSGSQDVHQKRVLLLTVPGMEETTSEADKNLSKQAWDTKKTGSRPKSCEVPGINIFPSADQENTTALIPATHNTGGSLPDLTNIHFPSPLPTPLDPEEPTFPALSSSSSTGNLAANLTHLGIGGAGQGMSTPGSSPQHRPAGVSPLSLSTEARRQQASPTLSPLSPITQAVAMDALSLEQQLPYAFFTQAGSQQPPPQPQPPPPPPPASQQPPPPPPPQAPVRLPPGGPLLPSASLTRGPQPPPLAVTVPSSLPQSPPENPGQPSMGIDIASAPALQQYRTSAGSPANQSPTSPVSNQGFSPGSSPQHTSTLGSVFGDAYYEQQMAARQANALSHQLEQFNMMENAISSSSLYSPGSTLNYSQAAMMGLTGSHGSLPDSQQLGYASHSGIPNIILTVTGESPPSLSKELTSSLAGVGDVSFDSDSQFPLDELKIDPLTLDGLHMLNDPDMVLADPATEDTFRMDRL

SEQ ID NO: 20183 - protein, 650 aa, Homo sapiens
  Payload ID: 4025
  Gene Symbol: CRTC1
  Gene Name: CREB regulated transcription coactivator 1
  Uniprot ID: Q6UUV9
  ENSP ID: ENSP00000345001
MATSNNPRKFSEKIALHNQKQAEETAAFEEVMKDLSLTRAARLQLQKSQYLQLGPSRGQYYGGSLPNVNQIGSGTMDLPFQPSGFLGEALAAAPVSLTPFQSSGLDTSRTTRHHGLVDRVYRERGRLGSPHRRPLSVDKHGRQADSCPYGTMYLSPPADTSWRRTNSDSALHQSTMTPTQPESFSSGSQDVHQKRVLLLTVPGMEETTSEADKNLSKQAWDTKKTGSRPKSCEVPGINIFPSADQENTTALIPATHNTGGSLPDLTNIHFPSPLPTPLDPEEPTFPALSSSSSTGNLAANLTHLGIGGAGQGMSTPGSSPQHRPAGVSPLSLSTEARRQQASPTLSPLSPITQAVAMDALSLEQQLPYAFFTQAGSQQPPPQPQPPPPPPPASQQPPPPPPPQAPVRLPPGGPLLPSASLTRGPQPPPLAVTVPSSLPQSPPENPGQPSMGIDIASAPALQQYRTSAGSPANQSPTSPVSNQGFSPGSSPQHTSTLGSVFGDAYYEQQMAARQANALSHQLEQFNMMENAISSSSLYSPGSTLNYSQAAMMGLTGSHGSLPDSQQLGYASHSGIPNIILTVTGESPPSLSKELTSSLAGVGDVSFDSDSQFPLDELKIDPLTLDGLHMLNDPDMVLADPATEDTFRMDRL

SEQ ID NO: 20184 - protein, 593 aa, Homo sapiens
  Payload ID: 4025
  Gene Symbol: CRTC1
  Gene Name: CREB regulated transcription coactivator 1
  ENSP ID: ENSP00000468893
MLQLQKSQYLQLGPSRGQYYGGSLPNVNQIGSGTMDLPFQTPFQSSGLDTSRTTRHHGLVDRVYRERGRLGSPHRRPLSVDKHGRQADSCPYGTMYLSPPADTSWRRTNSDSALHQSTMTPTQPESFSSGSQDVHQKRVLLLTVPGMEETTSEADKNLSKQAWDTKKTGSRPKSCEVPGINIFPSADQENTTALIPATHNTGGSLPDLTNIHFPSPLPTPLDPEEPTFPALSSSSSTGNLAANLTHLGIGGAGQGMSTPGSSPQHRPAGVSPLSLSTEARRQQASPTLSPLSPITQAVAMDALSLEQQLPYAFFTQAGSQQPPPQPQPPPPPPPASQQPPPPPPPQAPVRLPPGGPLLPSASLTRGPQPPPLAVTVPSSLPQSPPENPGQPSMGIDIASAPALQQYRTSAGSPANQSPTSPVSNQGFSPGSSPQHTSTLGSVFGDAYYEQQMAARQANALSHQLEQFNMMENAISSSSLYSPGSTLNYSQAAMMGLTGSHGSLPDSQQLGYASHSGIPNIILTVTGESPPSLSKELTSSLAGVGDVSFDSDSQFPLDELKIDPLTLDGLHMLNDPDMVLADPATEDTFRMDRL

SEQ ID NO: 20185 - protein, 392 aa, Homo sapiens
  Payload ID: 4025
  Gene Symbol: CRTC1
  Gene Name: CREB regulated transcription coactivator 1
  ENSP ID: ENSP00000469285
MDLPFQTPFQSSGLDTSRTTRHHGLVDRVYRERGRLGSPHRRPLSVDKHGRQADSCPYGTMYLSPPADTSWRRTNSDSALHQSTMTPTQPESFSSGSQDVHQKRVLLLTVPGMEETTSEADKNLSKQAWDTKKTGSRPKSCEVPGINIFPSADQENTTALIPATHNTGGSLPDLTNIHFPSPLPTPLDPEEPTFPALSSSSSTGNLAANLTHLGIGGAGQGMSTPGSSPQHRPAGVSPLSLSTEARRQQASPTLSPLSPITQLEQFNMMENAISSSSLYSPGSTLNYSQAAMMGLTGSHGSLPDSQQLGYASHSGIPNIILTVTGESPPSLSKELTSSLAGVGDVSFDSDSQFPLDELKIDPLTLDGLHMLNDPDMVLADPATEDTFRMDRL

SEQ ID NO: 20186 - protein, 54 aa, Homo sapiens
  Payload ID: 4026
  Gene Symbol: CRTC2
  Gene Name: CREB regulated transcription coactivator 2
  ENSP ID: ENSP00000305873
MATSGANGPGSATASASNPRKFSEKIALQKQRQAEETAAFEEVMMDIGSTRDKL

SEQ ID NO: 20187 - protein, 373 aa, Homo sapiens
  Payload ID: 4026
  Gene Symbol: CRTC2
  Gene Name: CREB regulated transcription coactivator 2
  ENSP ID: ENSP00000357619
MATSGANGPGSATASASNPRKFSEKIALQKQRQASLSSPQPQLQGSHSHPSLPASSLARHVLPTTSLGHPSLSAPALSSSSSSSSTSSPVLGAPSYPASTPGASPHHRRVPLSPLSLLAGPADARRSQQQLPKQFSPTMSPTLSSITQGVPLDTSKLSTDQRLPPYPYSSPSLVLPTQPHTPKSLQQPGLPSQSCSVQSSGGQPPGRQSHYGTPYPPGPSGHGQQSYHRPMSDFNLGNLEQFSMESPSASLVLDPPGFSEGPGFLGGEGPMGGPQDPHTFNHQNLTHCSRHGSGPNIILTGDSSPGFSKEIAAALAGVPGFEVSAAGLELGLGLEDELRMEPLGLEGLNMLSDPCALLPDPAVEESFRSDRLQ

SEQ ID NO: 20188 - protein, 693 aa, Homo sapiens
  Payload ID: 4026
  Gene Symbol: CRTC2
  Gene Name: CREB regulated transcription coactivator 2
  Uniprot ID: Q53ET0
  ENSP ID: ENSP00000357622
MATSGANGPGSATASASNPRKFSEKIALQKQRQAEETAAFEEVMMDIGSTRLQAQKLRLAYTRSSHYGGSLPNVNQIGSGLAEFQSPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGLHSPLSHPSLQSSLSNPNLQASLSSPQPQLQGSHSHPSLPASSLARHVLPTTSLGHPSLSAPALSSSSSSSSTSSPVLGAPSYPASTPGASPHHRRVPLSPLSLLAGPADARRSQQQLPKQFSPTMSPTLSSITQGVPLDTSKLSTDQRLPPYPYSSPSLVLPTQPHTPKSLQQPGLPSQSCSVQSSGGQPPGRQSHYGTPYPPGPSGHGQQSYHRPMSDFNLGNLEQFSMESPSASLVLDPPGFSEGPGFLGGEGPMGGPQDPHTFNHQNLTHCSRHGSGPNIILTGDSSPGFSKEIAAALAGVPGFEVSAAGLELGLGLEDELRMEPLGLEGLNMLSDPCALLPDPAVEESFRSDRLQ

SEQ ID NO: 20189 - protein, 481 aa, Homo sapiens
  Payload ID: 4026
  Gene Symbol: CRTC2
  Gene Name: CREB regulated transcription coactivator 2
  ENSP ID: ENSP00000434115
SPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVFLFQVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGLHSPLSHPSLQSSLSNPNLQASLSSPQPQLQGSHSHPSLPASSLARHVLPTTSLGHPSLSAPALSSSSSSSSTSSPVLGAPSYPASTPGASPHHRRVPLSPLSLLAGPADARRSQQQLPKQFSPTMSPTLSSITQGVPLDTSKLSTDQRLPPYPYSSPSLVLPTQPHTPKSLQQPGLPSQSCSVQSSGGQPPGRQSHYGTPYPPGPSGHGQQSYHRPMSDFNLGNLAL

SEQ ID NO: 20190 - protein, 619 aa, Homo sapiens
  Payload ID: 4027
  Gene Symbol: CRTC3
  Gene Name: CREB regulated transcription coactivator 3
  Uniprot ID: Q6UUV7
  ENSP ID: ENSP00000268184
MAASPGSGSANPRKFSEKIALHTQRQAEETRAFEQLMTDLTLSRVQFQKLQQLRLTQYHGGSLPNVSQLRSSASEFQPSFHQADNVRGTRHHGLVERPSRNRFHPLHRRSGDKPGRQFDGSAFGANYSSQPLDESWPRQQPPWKDEKHPGFRLTSALNRTNSDSALHTSALSTKPQDPYGGGGQSAWPAPYMGFCDGENNGHGEVASFPGPLKEENLLNVPKPLPKQLWETKEIQSLSGRPRSCDVGGGNAFPHNGQNLGLSPFLGTLNTGGSLPDLTNLHYSTPLPASLDTTDHHFGSMSVGNSVNNIPAAMTHLGIRSSSGLQSSRSNPSIQATLNKTVLSSSLNNHPQTSVPNASALHPSLRLFSLSNPSLSTTNLSGPSRRRQPPVSPLTLSPGPEAHQGFSRQLSSTSPLAPYPTSQMVSSDRSQLSFLPTEAQAQVSPPPPYPAPQELTQPLLQQPRAPEAPAQQPQAASSLPQSDFQLLPAQGSSLTNFFPDVGFDQQSMRPGPAFPQQVPLVQQGSRELQDSFHLRPSPYSNCGSLPNTILPEDSSTSLFKDLNSALAGLPEVSLNVDTPFPLEEELQIEPLSLDGLNMLSDSSMGLLDPSVEETFRADRL

SEQ ID NO: 20191 - protein, 618 aa, Homo sapiens
  Payload ID: 4027
  Gene Symbol: CRTC3
  Gene Name: CREB regulated transcription coactivator 3
  Uniprot ID: Q6UUV7
  ENSP ID: ENSP00000416573
MAASPGSGSANPRKFSEKIALHTQRQAEETRAFEQLMTDLTLSRVQFQKLQQLRLTQYHGGSLPNVSQLRSSASEFQPSFHQADNVRGTRHHGLVERPSRNRFHPLHRRSGDKPGRQFDGSAFGANYSSQPLDESWPRQQPPWKDEKHPGFRLTSALNRTNSDSALHTSALSTKPQDPYGGGGQSAWPAPYMGFCDGENNGHGEVASFPGPLKEENLLNVPKPLPKQLWETKEIQSLSGRPRSCDVGGGNAFPHNGQNLGLSPFLGTLNTGGSLPDLTNLHYSTPLPASLDTTDHHFGSMSVGNSVNNIPAAMTHLGIRSSSGLQSSRSNPSIQATLNKTVLSSSLNNHPQTSVPNASALHPSLRLFSLSNPSLSTTNLSGPSRRRQPPVSPLTLSPGPEAHQGFSRQLSSTSPLAPYPTSQMVSSDRSQLSFLPTEAQAQVSPPPPYPAPQELTQPLLQQPRAPEAPAQQPQAASSLPQSDFQLLPAQGSSLTNFFPDVGFDQQSMRPGPAFPQQVPLVQQGSRELQDSFHLRPSPYSNCGSLPNTILPDSSTSLFKDLNSALAGLPEVSLNVDTPFPLEEELQIEPLSLDGLNMLSDSSMGLLDPSVEETFRADRL

SEQ ID NO: 20192 - protein, 91 aa, Homo sapiens
  Payload ID: 4027
  Gene Symbol: CRTC3
  Gene Name: CREB regulated transcription coactivator 3
  ENSP ID: ENSP00000452640
MAASPGSGSANPRKFSEKIALHTQRQAEETRAFEQLMTDLTLSRVQFQKLQQLRLTQYHGGSLPNVSQLRSSASEFQVERNSSPCVDGLRQ

SEQ ID NO: 20193 - protein, 190 aa, Homo sapiens
  Payload ID: 4027
  Gene Symbol: CRTC3
  Gene Name: CREB regulated transcription coactivator 3
  ENSP ID: ENSP00000452676
  MOD_RES (1)..(1): Any amino acid
XHPLHRRSGDKPGRQFDGSAFGANYSSQPLDESWPRQQPPWKDEKHPGFRLTSALNRTNSDSALHTSALSTKPQDPYGGGGQSAWPAPYMVASFPGPLKEENLLNVPKPLPKQLWETKEIQSLSGRPRSCDVGGGNAFPHNGQNLGLSPFLGTLNTGGSLPDLTNLHYSTPLPASLDTTDHHFGSMSVGN

SEQ ID NO: 20194 - protein, 284 aa, Homo sapiens
  Payload ID: 4028
  Gene Symbol: CREBZF
  Gene Name: CREB/ATF bZIP transcription factor
  ENSP ID: ENSP00000260058
VRAPSPEEMEEEAIASLPGEETEDMDFLSGLELADLLDPRQPDWHLDPGLSSPGPLSSSGGGSDSGGLWRGDDDDEAAAAEMQRFSDLLQRLLNGIGGCSSSSDSGSAEKRRRKSPGGGGGGGSGNDNNQAATKSPRKAAAAAARLNRLKKKEYVMGLESRVRGLAAENQELRAENRELGKRVQALQEESRYLRAVLANETGLARLLSRLSGVGLRLTTSLFRDSPAGDHDYALPVGKQKQDLLEEDDSAGGVCLHVDKDKVSVEFCSACARKASSSLKIFFFR

SEQ ID NO: 20195 - protein, 130 aa, Homo sapiens
  Payload ID: 4028
  Gene Symbol: CREBZF
  Gene Name: CREB/ATF bZIP transcription factor
  ENSP ID: ENSP00000433380
  MOD_RES (1)..(1): Any amino acid
XMGLESRVRGLAAENQELRAENRELGKRVQALQEESRYLRAVLANETGLARLLSRLSGVGLRLTTSLFRDSPAGDHDYALPVGKQKQDLLEEDDSAGGVCLHVDKDKVSVEFCSACARKASSSLKIFFFR

SEQ ID NO: 20196 - protein, 354 aa, Homo sapiens
  Payload ID: 4028
  Gene Symbol: CREBZF
  Gene Name: CREB/ATF bZIP transcription factor
  Uniprot ID: Q9NS37
  ENSP ID: ENSP00000433459
MRHSLTKLLAASGSNSPTRSESPEPAATCSLPSDLTRAAAGEEETAAAGSPGRKQQFGDEGELEAGRGSRGGVAVRAPSPEEMEEEAIASLPGEETEDMDFLSGLELADLLDPRQPDWHLDPGLSSPGPLSSSGGGSDSGGLWRGDDDDEAAAAEMQRFSDLLQRLLNGIGGCSSSSDSGSAEKRRRKSPGGGGGGGSGNDNNQAATKSPRKAAAAAARLNRLKKKEYVMGLESRVRGLAAENQELRAENRELGKRVQALQEESRYLRAVLANETGLARLLSRLSGVGLRLTTSLFRDSPAGDHDYALPVGKQKQDLLEEDDSAGGVCLHVDKDKVSVEFCSACARKASSSLKM

SEQ ID NO: 20197 - protein, 354 aa, Homo sapiens; identical to SEQ ID NO: 20196
  Payload ID: 4028
  Gene Symbol: CREBZF
  Gene Name: CREB/ATF bZIP transcription factor
  Uniprot ID: Q9NS37
  ENSP ID: ENSP00000434281

SEQ ID NO: 20198 - protein, 358 aa, Homo sapiens
  Payload ID: 4028
  Gene Symbol: CREBZF
  Gene Name: CREB/ATF bZIP transcription factor
  ENSP ID: ENSP00000435762
MRHSLTKLLAASGSNSPTRSESPEPAATCSLPSDLTRAAAGEEETAAAGSPGRKQQFGDEGELEAGRGSRGGVAVRAPSPEEMEEEAIASLPGEETEDMDFLSGLELADLLDPRQPDWHLDPGLSSPGPLSSSGGGSDSGGLWRGDDDDEAAAAEMQRFSDLLQRLLNGIGGCSSSSDSGSAEKRRRKSPGGGGGGGSGNDNNQAATKSPRKAAAAAARLNRLKKKEYVMGLESRVRGLAAENQELRAENRELGKRVQALQEESRYLRAVLANETGLARLLSRLSGVGLRLTTSLFRDSPAGDHDYALPVGKQKQDLLEEDDSAGGVCLHVDKDKVSVEFCSACARKASSSLKIFFFR

SEQ ID NO: 20199 - protein, 67 aa, Homo sapiens
  Payload ID: 4028
  Gene Symbol: CREBZF
  Gene Name: CREB/ATF bZIP transcription factor
  ENSP ID: ENSP00000435980
MRADPPASLPLLLPPTTFSFLGDFLPARLRCRGYRTVVPASQPVDTAVGAEETGPAAGHISCFILKA

SEQ ID NO: 20200 - protein, 639 aa, Homo sapiens
  Payload ID: 4029
  Gene Symbol: CREBRF
  Gene Name: CREB3 regulatory factor
  Uniprot ID: Q8IUR6
  ENSP ID: ENSP00000296953
MPQPSVSGMDPPFGDAFRSHTFSEQTLMSTDLLANSSDPDFMYELDREMNYQQNPRDNFLSLEDCKDIENLESFTDVLDNEGALTSNWEQWDTYCEDLTKYTKLTSCDIWGTKEVDYLGLDDFSSPYQDEEVISKTPTLAQLNSEDSQSVSDSLYYPDSLFSVKQNPLPSSFPGKKITSRAAAPVCSSKTLQAEVPLSDCVQKASKPTSSTQIMVKTNMYHNEKVNFHVECKDYVKKAKVKINPVQQSRPLLSQIHTDAAKENTCYCGAVAKRQEKKGMEPLQGHATPALPFKETQELLLSPLPQEGPGSLAAGESSSLSASTSVSDSSQKKEEHNYSLFVSDNLGEQPTKCSPEEDEEDEEDVDDEDHDEGFGSEHELSENEEEEEEEEDYEDDKDDDISDTFSEPGYENDSVEDLKEVTSISSRKRGKRRYFWEYSEQLTPSQQERMLRPSEWNRDTLPSNMYQKNGLHHGKYAVKKSRRTDVEDLTPNPKKLLQIGNELRKLNKVISDLTPVSELPLTARPRSRKEKNKLASRACRLKKKAQYEANKVKLWGLNTEYDNLLFVINSIKQEIVNRVQNPRDERGPNMGQKLEILIKDTLGLPVAGQTSEFVNQVLEKTAEGNPTGGLVGLRIPTSKV

SEQ ID NO: 20201 - protein, 417 aa, Homo sapiens
  Payload ID: 4029
  Gene Symbol: CREBRF
  Gene Name: CREB3 regulatory factor
  Uniprot ID: Q8IUR6
  ENSP ID: ENSP00000428290
MPQPSVSGMDPPFGDAFRSHTFSEQTLMSTDLLANSSDPDFMYELDREMNYQQNPRDNFLSLEDCKDIENLESFTDVLDNEGALTSNWEQWDTYCEDLTKYTKLTSCDIWGTKEVDYLGLDDFSSPYQDEEVISKTPTLAQLNSEDSQSVSDSLYYPDSLFSVKQNPLPSSFPGKKITSRAAAPVCSSKTLQAEVPLSDCVQKASKPTSSTQIMVKTNMYHNEKVNFHVECKDYVKKAKVKINPVQQSRPLLSQIHTDAAKENTCYCGAVAKRQEKKGMEPLQGHATPALPFKETQELLLSPLPQEGPGSLAAGESSSLSASTSVSDSSQKKEEHNYSLFVSDNLGEQPTKCSPEEDEEDEEDVDDEDHDEGFGSEHELSENEEEEEEEEDYEDDKDDDISDTFSEPGIIMLASLPD

SEQ ID NO: 20202 - protein, 26 aa, Homo sapiens
  Payload ID: 4029
  Gene Symbol: CREBRF
  Gene Name: CREB3 regulatory factor
  ENSP ID: ENSP00000430801
MPQPSVSGMDPPFGDAFRSHTFSEQT

SEQ ID NO: 20203 - protein, 417 aa, Homo sapiens; identical to SEQ ID NO: 20201
  Payload ID: 4029
  Gene Symbol: CREBRF
  Gene Name: CREB3 regulatory factor
  Uniprot ID: Q8IUR6
  ENSP ID: ENSP00000431107

SEQ ID NO: 20204 - protein, 223 aa, Homo sapiens
  Payload ID: 4030
  Gene Symbol: CFC1
  Gene Name: cripto, FRL-1, cryptic family 1
  Uniprot ID: P0CG37
  ENSP ID: ENSP00000259216
MTWRHHVRLLFTVSLALQIINLGNSYQREKHNGGREEVTKVATQKHRQSPLNWTSSHFGEVTGSAEGWGPEEPLPYSRAFGEGASARPRCCRNGGTCVLGSFCVCPAHFTGRYCEHDQRRSECGALEHGAWTLRACHLCRCIFGALHCLPLQTPDRCDPKDFLASHAHGPSAGGAPSLLLLLPCALLHRLLRPDAPAHPRSLVPSVLQRERRPCGRPGLGHRL

SEQ ID NO: 20205 - protein, 191 aa, Homo sapiens
  Payload ID: 4030
  Gene Symbol: CFC1
  Gene Name: cripto, FRL-1, cryptic family 1
  ENSP ID: ENSP00000480526
MTWRHHVRLLFTVSLALQIINLGNSYQREKHNGGREEVTKVATQKHRQSPLNWTSSHFGEVTGSAEGWGPEEPLPYSRAFGEVNAAPWSTEPGPSAPATSAGASSGPCTASPSRRLTAVTRKTSWPPTLTGRAPGARPACYSCCPAHSCTASCARMRPRTLGPWSLPSSSGSGAPAEGRDLGIAFNFLCCK

SEQ ID NO: 20206 - protein, 148 aa, Homo sapiens
  Payload ID: 4030
  Gene Symbol: CFC1
  Gene Name: cripto, FRL-1, cryptic family 1
  ENSP ID: ENSP00000480843
MTWRHHVRLLFTVSLALQIINLGNSYQREKHNGGREEVTKVATQKHRQSPLNWTSSHFGEVTGSAEGWGPEEPLPYSRAFGEDPKDFLASHAHGPSAGGAPSLLLLLPCALLHRLLRPDAPAHPRSLVPSVLQRERRPCGRPGLGHRL

SEQ ID NO: 20207 - protein, 223 aa, Homo sapiens
  Payload ID: 4031
  Gene Symbol: CFC1B
  Gene Name: cripto, FRL-1, cryptic family 1B
  Uniprot ID: P0CG36
  ENSP ID: ENSP00000281882
MTWRHHVRLLFTVSLALQIINLGNSYQREKHNGGREEVTKVATQKHRQSPLNWTSSHFGEVTGSAEGWGPEEPLPYSWAFGEGASARPRCCRNGGTCVLGSFCVCPAHFTGRYCEHDQRRSECGALEHGAWTLRACHLCRCIFGALHCLPLQTPDRCDPKDFLASHAHGPSAGGAPSLLLLLPCALLHRLLRPDAPAHPRSLVPSVLQRERRPCGRPGLGHRL

SEQ ID NO: 20208 - protein, 148 aa, Homo sapiens
  Payload ID: 4031
  Gene Symbol: CFC1B
  Gene Name: cripto, FRL-1, cryptic family 1B
  ENSP ID: ENSP00000480160
MTWRHHVRLLFTVSLALQIINLGNSYQREKHNGGREEVTKVATQKHRQSPLNWTSSHFGEVTGSAEGWGPEEPLPYSWAFGEDPKDFLASHAHGPSAGGAPSLLLLLPCALLHRLLRPDAPAHPRSLVPSVLQRERRPCGRPGLGHRL

SEQ ID NO: 20209 - protein, 191 aa, Homo sapiens
  Payload ID: 4031
  Gene Symbol: CFC1B
  Gene Name: cripto, FRL-1, cryptic family 1B
  ENSP ID: ENSP00000483368
MTWRHHVRLLFTVSLALQIINLGNSYQREKHNGGREEVTKVATQKHRQSPLNWTSSHFGEVTGSAEGWGPEEPLPYSWAFGEVNAAPWSTEPGPSAPATSAGASSGPCTASPSRRLTAVTRKTSWPPTLTGRAPGARPACYSCCPAHSCTASCARMRPRTLGPWSLPSSSGSGAPAEGRDLGIAFNFLCCK

SEQ ID NO: 20210 - protein, 836 aa, Homo sapiens
  Payload ID: 4032
  Gene Symbol: CRNKL1
  Gene Name: crooked neck pre-mRNA splicing factor 1
  ENSP ID: ENSP00000366544
MTATVENLTFQKDTLGNAVDKNRRHGSTEPLVLAWSSQFRRLTWGCALDALHRSPCVAASQHGVTHLIRSSRTPHSTRCRKEDAQPGHHGNGAASVTAQARGQRSVLQVPLPVPRSCLFSESFVVSVSSQSRFLASVPGTGVQRSTAADMAASTAAGKQRIPKVAKVKNKAPAEVQITAEQLLREAKERELELLPPPPQQKITDEEELNDYKLRKRKTFEDNIRKNRTVISNWIKYAQWEESLKEIQRARSIYERALDVDYRNITLWLKYAEMEMKNRQVNHARNIWDRAITTLPRVNQFWYKYTYMEEMLGNVAGARQVFERWMEWQPEEQAWHSYINFELRYKEVDRARTIYERFVLVHPDVKNWIKYARFEEKHAYFAHARKVYERAVEFFGDEHMDEHLYVAFAKFEENQKEFERVRVIYKYALDRISKQDAQELFKNYTIFEKKFGDRRGIEDIIVSKRRFQYEEEVKANPHNYDAWFDYLRLVESDAEAEAVREVYERAIANVPPIQEKRHWKRYIYLWINYALYEELEAKDPERTRQVYQASLELIPHKKFTFAKMWILYAQFEIRQKNLSLARRALGTSIGKCPKNKLFKVYIELELQLREFDRCRKLYEKFLEFGPENCTSWIKFAELETILGDIDRARAIYELAISQPRLDMPEVLWKSYIDFEIEQEETERTRNLYRRLLQRTQHVKVWISFAQFELSSGKEGSLTKCRQIYEEANKTMRNCEEKEERLMLLESWRSFEEEFGTASDKERVDKLMPEKVKKRRKVQTDDGSDAGWEEYFDYIFPEDAANQPNLKLLAMAKLWKKQQQEKEDAEHHPDEDVDESES

SEQ ID NO: 20211 - protein, 848 aa, Homo sapiens
  Payload ID: 4032
  Gene Symbol: CRNKL1
  Gene Name: crooked neck pre-mRNA splicing factor 1
  Uniprot ID: Q9BZJ0
  ENSP ID: ENSP00000366557
MTATVENLTFQKDTLGNAVDKNTSRLELRSYSLAGRHGSTEPLVLAWSSQFRRLTWGCALDALHRSPCVAASQHGVTHLIRSSRTPHSTRCRKEDAQPGHHGNGAASVTAQARGQRSVLQVPLPVPRSCLFSESFVVSVSSQSRFLASVPGTGVQRSTAADMAASTAAGKQRIPKVAKVKNKAPAEVQITAEQLLREAKERELELLPPPPQQKITDEEELNDYKLRKRKTFEDNIRKNRTVISNWIKYAQWEESLKEIQRARSIYERALDVDYRNITLWLKYAEMEMKNRQVNHARNIWDRAITTLPRVNQFWYKYTYMEEMLGNVAGARQVFERWMEWQPEEQAWHSYINFELRYKEVDRARTIYERFVLVHPDVKNWIKYARFEEKHAYFAHARKVYERAVEFFGDEHMDEHLYVAFAKFEENQKEFERVRVIYKYALDRISKQDAQELFKNYTIFEKKFGDRRGIEDIIVSKRRFQYEEEVKANPHNYDAWFDYLRLVESDAEAEAVREVYERAIANVPPIQEKRHWKRYIYLWINYALYEELEAKDPERTRQVYQASLELIPHKKFTFAKMWILYAQFEIRQKNLSLARRALGTSIGKCPKNKLFKVYIELELQLREFDRCRKLYEKFLEFGPENCTSWIKFAELETILGDIDRARAIYELAISQPRLDMPEVLWKSYIDFEIEQEETERTRNLYRRLLQRTQHVKVWISFAQFELSSGKEGSLTKCRQIYEEANKTMRNCEEKEERLMLLESWRSFEEEFGTASDKERVDKLMPEKVKKRRKVQTDDGSDAGWEEYFDYIFPEDAANQPNLKLLAMAKLWKKQQQEKEDAEHHPDEDVDESES

SEQ ID NO: 20212 - protein, 74 aa, Homo sapiens
  Payload ID: 4032
  Gene Symbol: CRNKL1
  Gene Name: crooked neck pre-mRNA splicing factor 1
  Uniprot ID: Q9BZJ0
  ENSP ID: ENSP00000428436
MTATVENLTFQKDTLGNAVDKNILASLLVSTALPTSSAAPGRRTPRAAARRTRSLVTMETVPPPSRLKREVKGQ

SEQ ID NO: 20213 - protein, 104 aa, Homo sapiens
  Payload ID: 4032
  Gene Symbol: CRNKL1
  Gene Name: crooked neck pre-mRNA splicing factor 1
  ENSP ID: ENSP00000429226
MTATVENLTFQKDTLGNAVDKNRRHGSTEPLVLAWSSQFRRLTWGCALDALHRSPCVAASQHGVTHLIRSSRTPHSTRCRKEDAQPGHHGNGAASVTAQARGQR

SEQ ID NO: 20214 - protein, 687 aa, Homo sapiens
  Payload ID: 4032
  Gene Symbol: CRNKL1
  Gene Name: crooked neck pre-mRNA splicing factor 1
  Uniprot ID: Q9BZJ0
  ENSP ID: ENSP00000440733
MAASTAAGKQRIPKVAKVKNKAPAEVQITAEQLLREAKERELELLPPPPQQKITDEEELNDYKLRKRKTFEDNIRKNRTVISNWIKYAQWEESLKEIQRARSIYERALDVDYRNITLWLKYAEMEMKNRQVNHARNIWDRAITTLPRVNQFWYKYTYMEEMLGNVAGARQVFERWMEWQPEEQAWHSYINFELRYKEVDRARTIYERFVLVHPDVKNWIKYARFEEKHAYFAHARKVYERAVEFFGDEHMDEHLYVAFAKFEENQKEFERVRVIYKYALDRISKQDAQELFKNYTIFEKKFGDRRGIEDIIVSKRRFQYEEEVKANPHNYDAWFDYLRLVESDAEAEAVREVYERAIANVPPIQEKRHWKRYIYLWINYALYEELEAKDPERTRQVYQASLELIPHKKFTFAKMWILYAQFEIRQKNLSLARRALGTSIGKCPKNKLFKVYIELELQLREFDRCRKLYEKFLEFGPENCTSWIKFAELETILGDIDRARAIYELAISQPRLDMPEVLWKSYIDFEIEQEETERTRNLYRRLLQRTQHVKVWISFAQFELSSGKEGSLTKCRQIYEEANKTMRNCEEKEERLMLLESWRSFEEEFGTASDKERVDKLMPEKVKKRRKVQTDDGSDAGWEEYFDYIFPEDAANQPNLKLLAMAKLWKKQQQEKEDAEHHPDEDVDESES

SEQ ID NO: 20215 - protein, 674 aa, Homo sapiens
  Payload ID: 4033
  Gene Symbol: CRB1
  Gene Name: crumbs family member 1, photoreceptor morphogenesis associated
  ENSP ID: ENSP00000356367
MTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEW

SEQ ID NO: 20216 - protein, 1294 aa, Homo sapiens
  Payload ID: 4033
  Gene Symbol: CRB1
  Gene Name: crumbs family member 1, photoreceptor morphogenesis associated
  Uniprot ID: P82279
  ENSP ID: ENSP00000356369
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 20217 - protein, 1406 aa, Homo sapiens
  Payload ID: 4033
  Gene Symbol: CRB1
  Gene Name: crumbs family member 1, photoreceptor morphogenesis associated
  Uniprot ID: P82279
  ENSP ID: ENSP00000356370
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 20218 - protein, 42 aa, Homo sapiens
  Payload ID: 4033
  Gene Symbol: CRB1
  Gene Name: crumbs family member 1, photoreceptor morphogenesis associated
  ENSP ID: ENSP00000395407
EKDIDECASDPCVNGGLCQDLLNKFQCLCDVAFAGERCEVDY

SEQ ID NO: 20219 - protein, 1376 aa, Homo sapiens
  Payload ID: 4033
  Gene Symbol: CRB1
  Gene Name: crumbs family member 1, photoreceptor morphogenesis associated
  Uniprot ID: P82279
  ENSP ID: ENSP00000433932
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDVSSLSFYVSLLFWQNLFQLLSYLILRMNDEPVVEWGEQEDY

SEQ ID NO: 20220 - protein, 870 aa, Homo sapiens
  Payload ID: 4033
  Gene Symbol: CRB1
  Gene Name: crumbs family member 1, photoreceptor morphogenesis associated
  Uniprot ID: P82279
  ENSP ID: ENSP00000438091
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLRGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 20221 - protein, 1382 aa, Homo sapiens
  Payload ID: 4033
  Gene Symbol: CRB1
  Gene Name: crumbs family member 1, photoreceptor morphogenesis associated
  ENSP ID: ENSP00000438786
MKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKRQTNVGRALTELGSRGPKYQVSLFRFCVGSWATGNTFFLSSIKPGSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 20222 - protein, 1176 aa, Homo sapiens
  Payload ID: 4034
  Gene Symbol: CRB2
  Gene Name: crumbs family member 2
  Uniprot ID: Q5IJ48
  ENSP ID: ENSP00000353092
MALARPGTPDPQALASVLLLLLWAPALSLLAGTVPSEPPSACASDPCAPGTECQATESGGYTCGPMEPRGCATQPCHHGALCVPQGPDPTGFRCYCVPGFQGPRCELDIDECASRPCHHGATCRNLADRYECHCPLGYAGVTCEMEVDECASAPCLHGGSCLDGVGSFRCVCAPGYGGTRCQLDLDECQSQPCAHGGTCHDLVNGFRCDCAGTGYEGTHCEREVLECASAPCEHNASCLEGLGSFRCLCWPGYSGELCEVDEDECASSPCQHGGRCLQRSDPALYGGVQAAFPGAFSFRHAAGFLCHCPPGFEGADCGVEVDECASRPCLNGGHCQDLPNGFQCHCPDGYAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRWDGWAGGWAANAPWGYGGAEKSARSVDESLPFPGPHVLICDMRRTV

SEQ ID NO: 20223 - protein, 1285 aa, Homo sapiens
  Payload ID: 4034
  Gene Symbol: CRB2
  Gene Name: crumbs family member 2
  Uniprot ID: Q5IJ48
  ENSP ID: ENSP00000362734
MALARPGTPDPQALASVLLLLLWAPALSLLAGTVPSEPPSACASDPCAPGTECQATESGGYTCGPMEPRGCATQPCHHGALCVPQGPDPTGFRCYCVPGFQGPRCELDIDECASRPCHHGATCRNLADRYECHCPLGYAGVTCEMEVDECASAPCLHGGSCLDGVGSFRCVCAPGYGGTRCQLDLDECQSQPCAHGGTCHDLVNGFRCDCAGTGYEGTHCEREVLECASAPCEHNASCLEGLGSFRCLCWPGYSGELCEVDEDECASSPCQHGGRCLQRSDPALYGGVQAAFPGAFSFRHAAGFLCHCPPGFEGADCGVEVDECASRPCLNGGHCQDLPNGFQCHCPDGYAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRLPVPSKECSLNVTCLDGSPCEGGSPAANCSCLEGLAGQRCQVPTLPCEANPCLNGGTCRAAGGVSECICNARFSGQFCEVAKGLPLPLPFPLLEVAVPAACACLLLLLLGLLSGILAARKRRQSEGTYSPSQQEVAGARLEMDSVLKVPPEERLI

SEQ ID NO: 20224 - protein, 953 aa, Homo sapiens
  Payload ID: 4034
  Gene Symbol: CRB2
  Gene Name: crumbs family member 2
  Uniprot ID: Q5IJ48
  ENSP ID: ENSP00000435279
MAMEPGALWTFLGHLWLLAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRLPVPSKECSLNVTCLDGSPCEGGSPAANCSCLEGLAGQRCQVPTLPCEANPCLNGGTCRAAGGVSECICNARFSGQFCEVAKGLPLPLPFPLLEVAVPAACACLLLLLLGLLSGILAARKRRQSEGTYSPSQQEVAGARLEMDSVLKVPPEERLI

SEQ ID NO: 20225 - protein, 120 aa, Homo sapiens
  Payload ID: 4035
  Gene Symbol: CRB3
  Gene Name: crumbs family member 3
  Uniprot ID: Q9BUF7
  ENSP ID: ENSP00000310123
MANPGLGLLLALGLPFLLARWGRAWGQIQTTSANENSTVLPSSTSSSSDGNLRPEAITAIIVVFSLLAALLLAVGLALLVRKLREKRQTEGTYRPSSEEQVGARVPPTPNLKLPPEERLI

SEQ ID NO: 20226 - protein, 123 aa, Homo sapiens
  Payload ID: 4035
  Gene Symbol: CRB3
  Gene Name: crumbs family member 3
  Uniprot ID: Q9BUF7
  ENSP ID: ENSP00000349204
MANPGLGLLLALGLPFLLARWGRAWGQIQTTSANENSTVLPSSTSSSSDGNLRPEAITAIIVVFSLLAALLLAVGLALLVRKLREKRQTEGTYRPSSEEQFSHAAEARAPQDSKETVQGCLPI

SEQ ID NO: 20227 - protein, 120 aa, Homo sapiens; identical to SEQ ID NO: 20225
  Payload ID: 4035
  Gene Symbol: CRB3
  Gene Name: crumbs family member 3
  Uniprot ID: Q9BUF7
  ENSP ID: ENSP00000469707

SEQ ID NO: 20228 - protein, 120 aa, Homo sapiens; identical to SEQ ID NO: 20225
  Payload ID: 4035
  Gene Symbol: CRB3
  Gene Name: crumbs family member 3
  Uniprot ID: Q9BUF7
  ENSP ID: ENSP00000472010

SEQ ID NO: 20229 - protein, 586 aa, Homo sapiens
  Payload ID: 4036
  Gene Symbol: CRY1
  Gene Name: cryptochrome circadian clock 1
  Uniprot ID: Q16526
  ENSP ID: ENSP00000008527
MGVNAVHWFRKGLRLHDNPALKECIQGADTIRCVYILDPWFAGSSNVGINRWRFLLQCLEDLDANLRKLNSRLFVIRGQPADVFPRLFKEWNITKLSIEYDSEPFGKERDAAIKKLATEAGVEVIVRISHTLYDLDKIIELNGGQPPLTYKRFQTLISKMEPLEIPVETITSEVIEKCTTPLSDDHDEKYGVPSLEELGFDTDGLSSAVWPGGETEALTRLERHLERKAWVANFERPRMNANSLLASPTGLSPYLRFGCLSCRLFYFKLTDLYKKVKKNSSPPLSLYGQLLWREFFYTAATNNPRFDKMEGNPICVQIPWDKNPEALAKWAEGRTGFPWIDAIMTQLRQEGWIHHLARHAVACFLTRGDLWISWEEGMKVFEELLLDADWSINAGSWMWLSCSSFFQQFFHCYCPVGFGRRTDPNGDYIRRYLPVLRGFPAKYIYDPWNAPEGIQKVAKCLIGVNYPKPMVNHAEASRLNIERMKQIYQQLSRYRGLGLLASVPSNPNGNGGFMGYSAENIPGCSSSGSCSQGSGILHYAHGDSQQTHLLKQGRSSMGTGLSGGKRPSQEEDTQSIGPKVQRQSTN

SEQ ID NO: 20230 - protein, 106 aa, Homo sapiens
  Payload ID: 4036
  Gene Symbol: CRY1
  Gene Name: cryptochrome circadian clock 1
  ENSP ID: ENSP00000447738
IERMKQIYQQLSRYRGLGLLASVPSNPNGNGGFMGYSAENIPGCSSSGSCSQGSGILHYAHGDSQQTHLLKQGRSSMGTGLSGGKRPSQEEDTQSIGPKVQRQSTN

SEQ ID NO: 20231 - protein, 532 aa, Homo sapiens
  Payload ID: 4037
  Gene Symbol: CRY2
  Gene Name: cryptochrome circadian clock 2
  Uniprot ID: Q49AN0
  ENSP ID: ENSP00000397419
MPAPPGRTHTWFLLQSLEDLDTSLRKLNSRLFVVRGQPADVFPRLFKEWGVTRLTFEYDSEPFGKERDAAIMKMAKEAGVEVVTENSHTLYDLDRIIELNGQKPPLTYKRFQAIISRMELPKKPVGLVTSQQMESCRAEIQENHDETYGVPSLEELGFPTEGLGPAVWQGGETEALARLDKHLERKAWVANYERPRMNANSLLASPTGLSPYLRFGCLSCRLFYYRLWDLYKKVKRNSTPPLSLFGQLLWREFFYTAATNNPRFDRMEGNPICIQIPWDRNPEALAKWAEGKTGFPWIDAIMTQLRQEGWIHHLARHAVACFLTRGDLWVSWESGVRVFDELLLDADFSVNAGSWMWLSCSAFFQQFFHCYCPVGFGRRTDPSGDYIRRYLPKLKAFPSRYIYEPWNAPESIQKAAKCIIGVDYPRPIVNHAETSRLNIERMKQIYQQLSRYRGLCLLASVPSCVEDLSHPVAEPSSSQAGSMSSAGPRPLPSGPASPKRKLEAAEEPPGEELSKRARVAELPTPELPSKDA

SEQ ID NO: 20232 - protein, 614 aa, Homo sapiens
  Payload ID: 4037
  Gene Symbol: CRY2
  Gene Name: cryptochrome circadian clock 2
  ENSP ID: ENSP00000406751
MGGVHVAYRGGAGVAGAVWTVMAATVATAAAVAPAPAPGTDSASSVHWFRKGLRLHDNPALLAAVRGARCVRCVYILDPWFAASSSVGINRWRFLLQSLEDLDTSLRKLNSRLFVVRGQPADVFPRLFKEWGVTRLTFEYDSEPFGKERDAAIMKMAKEAGVEVVTENSHTLYDLDRIIELNGQKPPLTYKRFQAIISRMELPKKPVGLVTSQQMESCRAEIQENHDETYGVPSLEELGFPTEGLGPAVWQGGETEALARLDKHLERKAWVANYERPRMNANSLLASPTGLSPYLRFGCLSCRLFYYRLWDLYKKVKRNSTPPLSLFGQLLWREFFYTAATNNPRFDRMEGNPICIQIPWDRNPEALAKWAEGKTGFPWIDAIMTQLRQEGWIHHLARHAVACFLTRGDLWVSWESGVRVFDELLLDADFSVNAGSWMWLSCSAFFQQFFHCYCPVGFGRRTDPSGDYIRRYLPKLKAFPSRYIYEPWNAPESIQKAAKCIIGVDYPRPIVNHAETSRLNIERMKQIYQQLSRYRGLCLLASVPSCVEDLSHPVAEPSSSQAGSMSSAGPRPLPSGPASPKRKLEAAEEPPGEELSKRARVAELPTPELPSKDA

SEQ ID NO: 20233 - protein, 614 aa, Homo sapiens; identical to SEQ ID NO: 20232
  Payload ID: 4037
  Gene Symbol: CRY2
  Gene Name: cryptochrome circadian clock 2
  ENSP ID: ENSP00000478187

SEQ ID NO: 20234 - protein, 593 aa, Homo sapiens
  Payload ID: 4037
  Gene Symbol: CRY2
  Gene Name: cryptochrome circadian clock 2
  Uniprot ID: Q49AN0
  ENSP ID: ENSP00000484684
MAATVATAAAVAPAPAPGTDSASSVHWFRKGLRLHDNPALLAAVRGARCVRCVYILDPWFAASSSVGINRWRFLLQSLEDLDTSLRKLNSRLFVVRGQPADVFPRLFKEWGVTRLTFEYDSEPFGKERDAAIMKMAKEAGVEVVTENSHTLYDLDRIIELNGQKPPLTYKRFQAIISRMELPKKPVGLVTSQQMESCRAEIQENHDETYGVPSLEELGFPTEGLGPAVWQGGETEALARLDKHLERKAWVANYERPRMNANSLLASPTGLSPYLRFGCLSCRLFYYRLWDLYKKVKRNSTPPLSLFGQLLWREFFYTAATNNPRFDRMEGNPICIQIPWDRNPEALAKWAEGKTGFPWIDAIMTQLRQEGWIHHLARHAVACFLTRGDLWVSWESGVRVFDELLLDADFSVNAGSWMWLSCSAFFQQFFHCYCPVGFGRRTDPSGDYIRRYLPKLKAFPSRYIYEPWNAPESIQKAAKCIIGVDYPRPIVNHAETSRLNIERMKQIYQQLSRYRGLCLLASVPSCVEDLSHPVAEPSSSQAGSMSSAGPRPLPSGPASPKRKLEAAEEPPGEELSKRARVAELPTPELPSKDA

SEQ ID NO: 20235 - protein, 173 aa, Homo sapiens; identical to SEQ ID NO: 4306
  Payload ID: 4038
  Gene Symbol: CRYAA
  Gene Name: crystallin, alpha A
  Uniprot ID: P02489
  ENSP ID: ENSP00000291554

SEQ ID NO: 20236 - protein, 136 aa, Homo sapiens; identical to SEQ ID NO: 4307
  Payload ID: 4038
  Gene Symbol: CRYAA
  Gene Name: crystallin, alpha A
  ENSP ID: ENSP00000381200

SEQ ID NO: 20237 - protein, 153 aa, Homo sapiens
  Payload ID: 4038
  Gene Symbol: CRYAA
  Gene Name: crystallin, alpha A
  ENSP ID: ENSP00000381201
MSSACPRLAKLLASLLRCPAKAKRTGNGRPPPHPTTGLLSEPRVRSDRDKFVIFLDVKHFSPEDLTVKVQDDFVEIHGKHNERQDDHGYISREFHRRYRLPSNVDQSALSCSLSADGMLTFCGPKIQTGLDATHAERAIPVSREEKPTSAPSS

SEQ ID NO: 20238 - protein, 175 aa, Homo sapiens
  Payload ID: 4039
  Gene Symbol: CRYAB
  Gene Name: crystallin, alpha B
  Uniprot ID: P02511
  ENSP ID: ENSP00000227251
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 20239 - protein, 129 aa, Homo sapiens
  Payload ID: 4039
  Gene Symbol: CRYAB
  Gene Name: crystallin, alpha B
  ENSP ID: ENSP00000431754
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVD

SEQ ID NO: 20240 - protein, 77 aa, Homo sapiens
  Payload ID: 4039
  Gene Symbol: CRYAB
  Gene Name: crystallin, alpha B
  ENSP ID: ENSP00000432182
MDIAIHHPWIRRPFFPFHSPSRLFDQFFGEHLLESDLFPTSTSLSPFYLRPPSFLRAPSWFDTGLSEMRLEKDRFSV

SEQ ID NO: 20241 - protein, 106 aa, Homo sapiens
  Payload ID: 4039
  Gene Symbol: CRYAB
  Gene Name: crystallin, alpha B
  ENSP ID: ENSP00000432454
  MOD_RES (1)..(1): Any amino acid
XGPANIDLNLWEIPLNISMPQGLKNNEVLDCFRLLRFSLDEHGFISREFHRKYRIPADVDPLTITSSLSSDGVLTVNGPRKQVSGPERTIPITREEKPAVTAAPKK

SEQ ID NO: 20242 - protein, 175 aa, Homo sapiens; identical to SEQ ID NO: 20238
  Payload ID: 4039
  Gene Symbol: CRYAB
  Gene Name: crystallin, alpha B
  Uniprot ID: P02511
  ENSP ID: ENSP00000433560

SEQ ID NO: 20243 - protein, 175 aa, Homo sapiens; identical to SEQ ID NO: 20238
  Payload ID: 4039
  Gene Symbol: CRYAB
  Gene Name: crystallin, alpha B
  Uniprot ID: P02511
  ENSP ID: ENSP00000434247

SEQ ID NO: 20244 - protein, 155 aa, Homo sapiens
  Payload ID: 4039
  Gene Symbol: CRYAB
  Gene Name: crystallin, alpha B
  ENSP ID: ENSP00000434269
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQVCSLFFCFLLIHSVHTVIVQVVLSALEAGYIPVPSHNSRDQGLQINV

SEQ ID NO: 20245 - protein, 106 aa, Homo sapiens
  Payload ID: 4039
  Gene Symbol: CRYAB
  Gene Name: crystallin, alpha B
  ENSP ID: ENSP00000434793
MRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAP

SEQ ID NO: 20246 - protein, 108 aa, Homo sapiens
  Payload ID: 4039
  Gene Symbol: CRYAB
  Gene Name: crystallin, alpha B
  ENSP ID: ENSP00000435046
MRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 20247 - protein, 108 aa, Homo sapiens; identical to SEQ ID NO: 20246
  Payload ID: 4039
  Gene Symbol: CRYAB
  Gene Name: crystallin, alpha B
  ENSP ID: ENSP00000435411

SEQ ID NO: 20248 - protein, 68 aa, Homo sapiens
  Payload ID: 4039
  Gene Symbol: CRYAB
  Gene Name: crystallin, alpha B
  ENSP ID: ENSP00000435931
MDIAIHHPWIRRPFFPFHSPSRLFDQFFGEHLLESDLFPTSTSLSPFYLRPPSFLRAPSWFDTGLSEM

SEQ ID NO: 20249 - protein, 108 aa, Homo sapiens; identical to SEQ ID NO: 20246
  Payload ID: 4039
  Gene Symbol: CRYAB
  Gene Name: crystallin, alpha B
  ENSP ID: ENSP00000435960

SEQ ID NO: 20250 - protein, 175 aa, Homo sapiens; identical to SEQ ID NO: 20238
  Payload ID: 4039
  Gene Symbol: CRYAB
  Gene Name: crystallin, alpha B
  Uniprot ID: P02511
  ENSP ID: ENSP00000436051

SEQ ID NO: 20251 - protein, 174 aa, Homo sapiens
  Payload ID: 4039
  Gene Symbol: CRYAB
  Gene Name: crystallin, alpha B
  ENSP ID: ENSP00000436089
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPK

SEQ ID NO: 20252 - protein, 175 aa, Homo sapiens; identical to SEQ ID NO: 20238
  Payload ID: 4039
  Gene Symbol: CRYAB
  Gene Name: crystallin, alpha B
  Uniprot ID: P02511
  ENSP ID: ENSP00000437149

SEQ ID NO: 20253 - protein, 175 aa, Homo sapiens; identical to SEQ ID NO: 20238
  Payload ID: 4039
  Gene Symbol: CRYAB
  Gene Name: crystallin, alpha B
  Uniprot ID: P02511
  ENSP ID: ENSP00000483554

SEQ ID NO: 20254 - protein, 215 aa, Homo sapiens
  Payload ID: 4040
  Gene Symbol: CRYBA1
  Gene Name: crystallin, beta A1
  Uniprot ID: P05813
  ENSP ID: ENSP00000225387
METQAEQQELETLPTTKMAQTNPTPGSLGPWKITIYDQENFQGKRMEFTSSCPNVSERSFDNVRSLKVESGAWIGYEHTSFCGQQFILERGEYPRWDAWSGSNAYHIERLMSFRPICSANHKESKMTIFEKENFIGRQWEISDDYPSLQAMGWFNNEVGSMKIQSGAWVCYQYPGYRGYQYILECDHHGGDYKHWREWGSHAQTSQIQSIRRIQQ

SEQ ID NO: 20255 - protein, 75 aa, Homo sapiens
  Payload ID: 4040
  Gene Symbol: CRYBA1
  Gene Name: crystallin, beta A1
  ENSP ID: ENSP00000464368
  MOD_RES (1)..(1): Any amino acid
XAEQQELETLPTTKMAQTNPTPGSLGPWKITIYDQENFQGKRMEFTSSCPNVSERSFDNVRSLKVESGAIIRSLR

SEQ ID NO: 20256 - protein, 197 aa, Homo sapiens
  Payload ID: 4041
  Gene Symbol: CRYBA2
  Gene Name: crystallin, beta A2
  Uniprot ID: P53672
  ENSP ID: ENSP00000295728
MSSAPAPGPAPASLTLWDEEDFQGRRCRLLSDCANVCERGGLPRVRSVKVENGVWVAFEYPDFQGQQFILEKGDYPRWSAWSGSSSHNSNQLLSFRPVLCANHNDSRVTLFEGDNFQGCKFDLVDDYPSLPSMGWASKDVGSLKVSSGAWVAYQYPGYRGYQYVLERDRHSGEFCTYGELGTQAHTGQLQSIRRVQH

SEQ ID NO: 20257 - protein, 197 aa, Homo sapiens; identical to SEQ ID NO: 20256
  Payload ID: 4041
  Gene Symbol: CRYBA2
  Gene Name: crystallin, beta A2
  Uniprot ID: P53672
  ENSP ID: ENSP00000375946

SEQ ID NO: 20258 - protein, 128 aa, Homo sapiens
  Payload ID: 4041
  Gene Symbol: CRYBA2
  Gene Name: crystallin, beta A2
  ENSP ID: ENSP00000395120
MSSAPAPGPAPASLTLWDEEDFQGRRCRLLSDCANVCERGGLPRVRSVKVENGVWVAFEYPDFQGQQFILEKGDYPRWSAWSGSSSHNSNQLLSFRPVLCANHNDSRVTLFEGDNFQGCKFDLVDDYP

SEQ ID NO: 20259 - protein, 196 aa, Homo sapiens
  Payload ID: 4042
  Gene Symbol: CRYBA4
  Gene Name: crystallin, beta A4
  Uniprot ID: P53673
  ENSP ID: ENSP00000346805
MTLQCTKSAGPWKMVVWDEDGFQGRRHEFTAECPSVLELGFETVRSLKVLSGAWVGFEHAGFQGQQYILERGEYPSWDAWGGNTAYPAERLTSFRPAACANHRDSRLTIFEQENFLGKKGELSDDYPSLQAMGWEGNEVGSFHVHSGAWVCSQFPGYRGFQYVLECDHHSGDYKHFREWGSHAPTFQVQSIRRIQQ

SEQ ID NO: 20260 - protein, 252 aa, Homo sapiens
  Payload ID: 4043
  Gene Symbol: CRYBB1
  Gene Name: crystallin, beta B1
  Uniprot ID: P53674
  ENSP ID: ENSP00000215939
MSQAAKASASATVAVNPGPDTKGKGAPPAGTSPSPGTTLAPTTVPITSAKAAELPPGNYRLVVFELENFQGRRAEFSGECSNLADRGFDRVRSIIVSAGPWVAFEQSNFRGEMFILEKGEYPRWNTWSSSYRSDRLMSFRPIKMDAQEHKISLFEGANFKGNTIEIQGDDAPSLWVYGFSDRVGSVKVSSGTWVGYQYPGYRGYQYLLEPGDFRHWNEWGAFQPQMQSLRRLRDKQWHLEGSFPVLATEPPK

SEQ ID NO: 20261 - protein, 205 aa, Homo sapiens
  Payload ID: 4044
  Gene Symbol: CRYBB2
  Gene Name: crystallin, beta B2
  Uniprot ID: P43320
  ENSP ID: ENSP00000381273
MASDHQTQAGKPQSLNPKIIIFEQENFQGHSHELNGPCPNLKETGVEKAGSVLVQAGPWVGYEQANCKGEQFVFEKGEYPRWDSWTSSRRTDSLSSLRPIKVDSQEHKIILYENPNFTGKKMEIIDDDVPSFHAHGYQEKVSSVRVQSGTWVGYQYPGYRGLQYLLEKGDYKDSSDFGAPHPQVQSVRRIRDMQWHQRGAFHPSN

SEQ ID NO: 20262 - protein, 211 aa, Homo sapiens
  Payload ID: 4045
  Gene Symbol: CRYBB3
  Gene Name: crystallin, beta B3
  Uniprot ID: P26998
  ENSP ID: ENSP00000215855
MAEQHGAPEQAAAGKSHGDLGGSYKVILYELENFQGKRCELSAECPSLTDSLLEKVGSIQVESGPWLAFESRAFRGEQFVLEKGDYPRWDAWSNSRDSDSLLSLRPLNIDSPHHKLHLFENPAFSGRKMEIVDDDVPSLWAHGFQDRVASVRAINGTWVGYEFPGYRGRQYVFERGEYRHWNEWDASQPQLQSVRRIRDQKWHKRGRFPSS

SEQ ID NO: 20263 - protein, 113 aa, Homo sapiens
  Payload ID: 4045
  Gene Symbol: CRYBB3
  Gene Name: crystallin, beta B3
  ENSP ID: ENSP00000386123
MAEQHGAPEQAAAGKSHGDLGGSYKVILYELENFQGKRCELSAECPSLTDSLLEKVGSIQVESGPWLAFESRAFRGEQFVLEKGDYPRWDAWSNSRDSDSLLSLRPLNIVGWL

SEQ ID NO: 20264 - protein, 174 aa, Homo sapiens
  Payload ID: 4046
  Gene Symbol: CRYGA
  Gene Name: crystallin, gamma A
  Uniprot ID: P11844
  ENSP ID: ENSP00000302105
MGKITFYEDRDFQGRCYNCISDCPNLRVYFSRCNSIRVDSGCWMLYERPNYQGHQYFLRRGKYPDYQHWMGLSDSVQSCRIIPHTSSHKLRLYERDDYRGLMSELTDDCACVPELFRLPEIYSLHVLEGCWVLYEMPNYRGRQYLLRPGDYRRYHDWGGADAKVGSLRRVTDLY

SEQ ID NO: 20265 - protein, 175 aa, Homo sapiens
  Payload ID: 4047
  Gene Symbol: CRYGB
  Gene Name: crystallin, gamma B
  Uniprot ID: P07316
  ENSP ID: ENSP00000260988
MGKITFYEDRAFQGRSYECTTDCPNLQPYFSRCNSIRVESGCWMIYERPNYQGHQYFLRRGEYPDYQQWMGLSDSIRSCCLIPPHSGAYRMKIYDRDELRGQMSELTDDCISVQDRFHLTEIHSLNVLEGSWILYEMPNYRGRQYLLRPGEYRRFLDWGAPNAKVGSLRRVMDLY

SEQ ID NO: 20266 - protein, 174 aa, Homo sapiens
  Payload ID: 4048
  Gene Symbol: CRYGC
  Gene Name: crystallin, gamma C
  Uniprot ID: P07315
  ENSP ID: ENSP00000282141
MGKITFYEDRAFQGRSYETTTDCPNLQPYFSRCNSIRVESGCWMLYERPNYQGQQYLLRRGEYPDYQQWMGLSDSIRSCCLIPQTVSHRLRLYEREDHKGLMMELSEDCPSIQDRFHLSEIRSLHVLEGCWVLYELPNYRGRQYLLRPQEYRRCQDWGAMDAKAGSLRRVVDLY

SEQ ID NO: 20267 - protein, 174 aa, Homo sapiens
  Payload ID: 4049
  Gene Symbol: CRYGD
  Gene Name: crystallin, gamma D
  Uniprot ID: P07320
  ENSP ID: ENSP00000264376
MGKITLYEDRGFQGRHYECSSDHPNLQPYLSRCNSARVDSGCWMLYEQPNYSGLQYFLRRGDYADHQQWMGLSDSVRSCRLIPHSGSHRIRLYEREDYRGQMIEFTEDCSCLQDRFRFNEIHSLNVLEGSWVLYELSNYRGRQYLLMPGDYRRYQDWGATNARVGSLRRVIDFS

SEQ ID NO: 20268 - protein, 182 aa, Homo sapiens
  Payload ID: 4050
  Gene Symbol: CRYGN
  Gene Name: crystallin, gamma N
  Uniprot ID: Q8WXF5
  ENSP ID: ENSP00000338613
MAQRSGKITLYEGKHFTGQKLEVFGDCDNFQDRGFMNRVNSIHVESGAWVCFNHPDFRGQQFILEHGDYPDFFRWNSHSDHMGSCRPVGMHGEHFRLEIFEGCNFTGQCLEFLEDSPFLQSRGWVKNCVNTIKVYGDGAAWSPRSFGAEDFQLSSSLQSDQGPEEATTKPATTQPPFLTANL

SEQ ID NO: 20269 - protein, 125 aa, Homo sapiens
  Payload ID: 4050
  Gene Symbol: CRYGN
  Gene Name: crystallin, gamma N
  Uniprot ID: Q8WXF5
  ENSP ID: ENSP00000420157
MAQRSGKITLYEGKHFTGQKLEVFGDCDNFQDRGFMNRVNSIHVESGAWVCFNHPDFRGQQFILEHGDYPDFFRWNSHSDHMGSCRPVGMVSGPVHRRLSLPAGGTEGQPWQTVARNRGAWSSRL

SEQ ID NO: 20270 - protein, 178 aa, Homo sapiens
  Payload ID: 4051
  Gene Symbol: CRYGS
  Gene Name: crystallin, gamma S
  Uniprot ID: P22914
  ENSP ID: ENSP00000312099
MSKTGTKITFYEDKNFQGRRYDCDCDCADFHTYLSRCNSIKVEGGTWAVYERPNFAGYMYILPQGEYPEYQRWMGLNDRLSSCRAVHLPSGGQYKIQIFEKGDFSGQMYETTEDCPSIMEQFHMREIHSCKVLEGVWIFYELPNYRGRQYLLDKKEYRKPIDWGAASPAVQSFRRIVE

SEQ ID NO: 20271 - protein, 178 aa, Homo sapiens; identical to SEQ ID NO: 20270
  Payload ID: 4051
  Gene Symbol: CRYGS
  Gene Name: crystallin, gamma S
  Uniprot ID: P22914
  ENSP ID: ENSP00000376287

SEQ ID NO: 20272 - protein, 319 aa, Homo sapiens
  Payload ID: 4052
  Gene Symbol: CRYL1
  Gene Name: crystallin, lambda 1
  Uniprot ID: Q9Y2S2
  ENSP ID: ENSP00000298248
MASSAAGCVVIVGSGVIGRSWAMLFASGGFQVKLYDIEQQQIRNALENIRKEMKLLEQAGSLKGSLSVEEQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVEEGIVSPSDLDLVMSEGLGMRYAFIGPLETMHLNAEGMLSYCDRYSEGIKHVLQTFGPIPEFSRATAEKVNQDMCMKVPDDPEHLAARRQWRDECLMRLAKLKSQVQPQ

SEQ ID NO: 20273 - protein, 297 aa, Homo sapiens
  Payload ID: 4052
  Gene Symbol: CRYL1
  Gene Name: crystallin, lambda 1
  Uniprot ID: Q9Y2S2
  ENSP ID: ENSP00000372262
MLFASGGFQVKLYDIEQQQIRNALENIRKEMKLLEQAGSLKGSLSVEEQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVEEGIVSPSDLDLVMSEGLGMRYAFIGPLETMHLNAEGMLSYCDRYSEGIKHVLQTFGPIPEFSRATAEKVNQDMCMKVPDDPEHLAARRQWRDECLMRLAKLKSQVQPQ

SEQ ID NO: 20274 - protein, 148 aa, Homo sapiens
  Payload ID: 4052
  Gene Symbol: CRYL1
  Gene Name: crystallin, lambda 1
  ENSP ID: ENSP00000479908
  MOD_RES (1)..(1): Any amino acid
XQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVELASVLG

SEQ ID NO: 20275 - protein, 314 aa, Homo sapiens
  Payload ID: 4053
  Gene Symbol: CRYM
  Gene Name: crystallin, mu
  Uniprot ID: Q14894
  ENSP ID: ENSP00000219599
MSRVPAFLSAAEVEEHLRSSSLLIPPLETALANFSSGPEGGVMQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVRIWNRTKENAEKFADTVQGEVRVCSSVQEAVAGADVIITVTLATEPILFGEWVKPGAHINAVGASRPDWRELDDELMKEAVLYVDSQEAALKESGDVLLSGAEIFAELGEVIKGVKPAHCEKTTVFKSLGMAVEDTVAAKLIYDSWSSGK

SEQ ID NO: 20276 - protein, 314 aa, Homo sapiens; identical to SEQ ID NO: 20275
  Payload ID: 4053
  Gene Symbol: CRYM
  Gene Name: crystallin, mu
  Uniprot ID: Q14894
  ENSP ID: ENSP00000440227

SEQ ID NO: 20277 - protein, 165 aa, Homo sapiens
  Payload ID: 4053
  Gene Symbol: CRYM
  Gene Name: crystallin, mu
  ENSP ID: ENSP00000459982
MSRVPAFLSAAEVEEHLRSSSLLIPPLETALANFSSGPEGGVMQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVI

SEQ ID NO: 20278 - protein, 241 aa, Homo sapiens
  Payload ID: 4053
  Gene Symbol: CRYM
  Gene Name: crystallin, mu
  ENSP ID: ENSP00000460126
MQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVRIWNRTKENAEKFADTVQGEVRVCSSVQEAVAGADVIITVTLATEPILFGEWVKPGAHINAVGASRPDWRELDDELMKEAVLYVDSQEAALKESGDVLLSGAEIFAELGEVIKGVKPAH

SEQ ID NO: 20279 - protein, 25 aa, Homo sapiens
  Payload ID: 4053
  Gene Symbol: CRYM
  Gene Name: crystallin, mu
  ENSP ID: ENSP00000460510
MSRVPAFLSAAEVEEHLRSSSLLIP

SEQ ID NO: 20280 - protein, 97 aa, Homo sapiens
  Payload ID: 4053
  Gene Symbol: CRYM
  Gene Name: crystallin, mu
  ENSP ID: ENSP00000460820
  MOD_RES (1)..(1): Any amino acid
XVGASRPDWRELDDELMKEAVLYVDSQEAALKESGDVLLSGAEIFAELGEVIKGVKPAHCEKTTVFKSLGMAVEDTVAAKLIYDSWSSAAPISLNLK

SEQ ID NO: 20281 - protein, 140 aa, Homo sapiens
  Payload ID: 4053
  Gene Symbol: CRYM
  Gene Name: crystallin, mu
  ENSP ID: ENSP00000461904
MSRVPAFLSAAEVEEHLRSSSLLIPPLETALANFSSGPEGGVMQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLC

SEQ ID NO: 20282 - protein, 329 aa, Homo sapiens
  Payload ID: 4054
  Gene Symbol: CRYZ
  Gene Name: crystallin, zeta (quinone reductase)
  Uniprot ID: Q08257
  ENSP ID: ENSP00000339399
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYIDKIKKYVGEKGIDIIIEMLANVNLSKDLSLLSHGGRVIVVGSRGTIEINPRDTMAKESSIIGVTLFSSTKEEFQQYAAALQAGMEIGWLKPVIGSQYPLEKVAEAHENIIHGSGATGKMILLL

SEQ ID NO: 20283 - protein, 243 aa, Homo sapiens
  Payload ID: 4054
  Gene Symbol: CRYZ
  Gene Name: crystallin, zeta (quinone reductase)
  ENSP ID: ENSP00000359907
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYIDKIKKYVGEKGIDIIIEMLANVNLSKDLSLLSHGGRV

SEQ ID NO: 20284 - protein, 295 aa, Homo sapiens
  Payload ID: 4054
  Gene Symbol: CRYZ
  Gene Name: crystallin, zeta (quinone reductase)
  Uniprot ID: Q08257
  ENSP ID: ENSP00000359908
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYIDKIKVVGSRGTIEINPRDTMAKESSIIGVTLFSSTKEEFQQYAAALQAGMEIGWLKPVIGSQYPLEKVAEAHENIIHGSGATGKMILLL

SEQ ID NO: 20285 - protein, 192 aa, Homo sapiens
  Payload ID: 4054
  Gene Symbol: CRYZ
  Gene Name: crystallin, zeta (quinone reductase)
  Uniprot ID: Q08257
  ENSP ID: ENSP00000359909
MHLLSSACVKAGESVLVHGASGGVGLAACQIARAYGLKILGTAGTEEGQKIVLQNGAHEVFNHREVNYIDKIKKYVGEKGIDIIIEMLANVNLSKDLSLLSHGGRVIVVGSRGTIEINPRDTMAKESSIIGVTLFSSTKEEFQQYAAALQAGMEIGWLKPVIGSQYPLEKVAEAHENIIHGSGATGKMILLL

SEQ ID NO: 20286 - protein, 329 aa, Homo sapiens; identical to SEQ ID NO: 20282
  Payload ID: 4054
  Gene Symbol: CRYZ
  Gene Name: crystallin, zeta (quinone reductase)
  Uniprot ID: Q08257
  ENSP ID: ENSP00000399805

SEQ ID NO: 20287 - protein, 206 aa, Homo sapiens
  Payload ID: 4054
  Gene Symbol: CRYZ
  Gene Name: crystallin, zeta (quinone reductase)
  ENSP ID: ENSP00000404289
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYI

SEQ ID NO: 20288 - protein, 334 aa, Homo sapiens
  Payload ID: 4055
  Gene Symbol: CRYZL1
  Gene Name: crystallin, zeta (quinone reductase)-like 1
  ENSP ID: ENSP00000290244
MKGLYFQQSSTDEEITFVFQEKEDLPVTEDNFVKLQVKACALSQINTKLLAEMKMKKDLFPVGREIAGIVLDGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLSNVQQGKYLCILKDVMEKLSTGVFRPQLDEPIPLYEAKVSMEAVQKNQGRKKQVVQF

SEQ ID NO: 20289 - protein, 325 aa, Homo sapiens
  Payload ID: 4055
  Gene Symbol: CRYZL1
  Gene Name: crystallin, zeta (quinone reductase)-like 1
  ENSP ID: ENSP00000355075
MWLLSQIGPLHYAKRRNHLERDVTMKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLSNVQQGKYL

SEQ ID NO: 20290 - protein, 322 aa, Homo sapiens
  Payload ID: 4055
  Gene Symbol: CRYZL1
  Gene Name: crystallin, zeta (quinone reductase)-like 1
  ENSP ID: ENSP00000370951
MKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLSNVQQGKYLSTYLKGCDGEVINWCFQTSVG

SEQ ID NO: 20291 - protein, 349 aa, Homo sapiens
  Payload ID: 4055
  Gene Symbol: CRYZL1
  Gene Name: crystallin, zeta (quinone reductase)-like 1
  Uniprot ID: O95825
  ENSP ID: ENSP00000370966
MKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLSNVQQGKYLCILKDVMEKLSTGVFRPQLDEPIPLYEAKVSMEAVQKNQGRKKQVVQF

SEQ ID NO: 20292 - protein, 24 aa, Homo sapiens
  Payload ID: 4055
  Gene Symbol: CRYZL1
  Gene Name: crystallin, zeta (quinone reductase)-like 1
  ENSP ID: ENSP00000382371
MWLLSQIGPLHYAKRRNHLERDTQ

SEQ ID NO: 20293 - protein, 158 aa, Homo sapiens
  Payload ID: 4055
  Gene Symbol: CRYZL1
  Gene Name: crystallin, zeta (quinone reductase)-like 1
  ENSP ID: ENSP00000387660
MKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCL

SEQ ID NO: 20294 - protein, 113 aa, Homo sapiens
  Payload ID: 4055
  Gene Symbol: CRYZL1
  Gene Name: crystallin, zeta (quinone reductase)-like 1
  ENSP ID: ENSP00000389209
MKGLYFQQSSTDEEITFVFQEKEDLPVTEDNFVKLQVKACALSQINTKLLAEMKMKKDLFPVGREIAGIVLDVGSKVSFFQPDDEVVEVLSRLGAVAHVCNPSTLGGQGGRIT

SEQ ID NO: 20295 - protein, 111 aa, Homo sapiens
  Payload ID: 4055
  Gene Symbol: CRYZL1
  Gene Name: crystallin, zeta (quinone reductase)-like 1
  ENSP ID: ENSP00000397318
  MOD_RES (1)..(1): Any amino acid
XRLYSKDDEPAVKLQLLPHKHDIITLLGVGGHWVTTEENLQLDPPDSHCLFLKGATLAFLNDEVWNLSNVQQGKYLCILKDVMEKLSTGVFRPQSDEHIPVFEARIFFGNC
